United States Patent 12,508,308 (INFLUENZA mRNA VACCINES) - sequence listing, part 31

SEQ ID NO: 118049 - RNA, 1755 nt, Artificial Sequence
  derived and/or modified sequence opt2 from hemagglutinin__InfluenzaB__ACD56566
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucgucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgacaagaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118050 - RNA, 1755 nt, Artificial Sequence
  derived and/or modified sequence opt2 from hemagglutinin__InfluenzaB__ACD56577
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaaggcccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118051 - RNA, 1758 nt, Artificial Sequence; identical to SEQ ID NO: 118032
  derived and/or modified sequence opt2 from hemagglutinin__InfluenzaB__ACF41658

SEQ ID NO: 118052 - RNA, 1758 nt, Artificial Sequence
  derived and/or modified sequence opt2 from hemagglutinin__InfluenzaB__ACF54136
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacaagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacaucuccugcuccaucugccucuga

SEQ ID NO: 118053 - RNA, 1758 nt, Artificial Sequence; identical to SEQ ID NO: 118026
  derived and/or modified sequence opt2 from hemagglutinin__InfluenzaB__ACF54147

SEQ ID NO: 118054 - RNA, 1755 nt, Artificial Sequence
  derived and/or modified sequence opt2 from hemagglutinin__InfluenzaB__ACF54158
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaagucccgccccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118055 - RNA, 1755 nt, Artificial Sequence
  derived and/or modified sequence opt2 from hemagglutinin__InfluenzaB__ACF54169
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccccaugaagaaccucuacggcgacuccaacccccagaaguucaccuccuccgccaacggcgucaccacccacuacgucucccagaucggcggcuuccccgcccagaccgaggacgagggcaucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucuccaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118056 - RNA, 1755 nt, Artificial Sequence
  derived and/or modified sequence opt2 from hemagglutinin__InfluenzaB__ACF54180
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccccaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118057 - RNA, 1755 nt, Artificial Sequence
  derived and/or modified sequence opt2 from hemagglutinin__InfluenzaB__ACF54202
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccucccgcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacgagggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118058 - RNA, 1755 nt, Artificial Sequence
  derived and/or modified sequence opt2 from hemagglutinin__InfluenzaB__ACF54213
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgagaacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118059 - RNA, 1758 nt, Artificial Sequence
  derived and/or modified sequence opt2 from hemagglutinin__InfluenzaB__ACF54224
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccuccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagcgcuacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118060 - RNA, 1755 nt, Artificial Sequence
  derived and/or modified sequence opt2 from hemagglutinin__InfluenzaB__ACF54257
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcgagaacaacaagaccgccaccaacccccucaccgucgaggucccccacaucugcaccaaggaggaggaccagaucaccgucuggggcuuccacuccgacaacaagccccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118061 - RNA, 1755 nt, Artificial Sequence
  derived and/or modified sequence opt2 from hemagglutinin__InfluenzaB__ACF54268
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcgagaacaacaagaccgccaccaacccccucaccgucgaggucccccacaucugcaccaaggaggaggaccagaucaccgucuggggcuuccacuccgacaacaagauccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118062 - RNA, 1755 nt, Artificial Sequence
  derived and/or modified sequence opt2 from hemagglutinin__InfluenzaB__ACF54279
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcgagaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118063 - RNA, 1755 nt, Artificial Sequence
  derived and/or modified sequence opt2 from hemagglutinin__InfluenzaB__ACF54290
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucgucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaagaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgacaagaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118064 - RNA, 1758 nt, Artificial Sequence
  derived and/or modified sequence opt2 from hemagglutinin__InfluenzaB__ACF54312
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccuccaacggcgucaccacccacuacaucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118065 - RNA, 1758 nt, Artificial Sequence
  derived and/or modified sequence opt2 from hemagglutinin__InfluenzaB__ACF54323
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccgcaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118066 - RNA, 1755 nt, Artificial Sequence
  derived and/or modified sequence opt2 from hemagglutinin__InfluenzaB__ACF54345
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaaggcccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccuccgcgagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118067 - RNA, 1755 nt, Artificial Sequence
  derived and/or modified sequence opt2 from hemagglutinin__InfluenzaB__ACF54367
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccgcccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacuccaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118068 - RNA, 1755 nt, Artificial Sequence
  derived and/or modified sequence opt2 from hemagglutinin__InfluenzaB__ACN32556
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuucgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118069 - RNA, 1758 nt, Artificial Sequence
  derived and/or modified sequence opt2 from hemagglutinin__InfluenzaB__ACN32567
auggaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118070 - RNA, 1758 nt, Artificial Sequence; identical to SEQ ID NO: 118026
  derived and/or modified sequence opt2 from hemagglutinin__InfluenzaB__ACN32578

SEQ ID NO: 118071 - RNA, 1758 nt, Artificial Sequence
  derived and/or modified sequence opt2 from hemagglutinin__InfluenzaB__ACN32589
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucuccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118072 - RNA, 1758 nt, Artificial Sequence
  derived and/or modified sequence opt2 from hemagglutinin__InfluenzaB__ACN32600
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucuccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgcccgccuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118073 - RNA, 1758 nt, Artificial Sequence; identical to SEQ ID NO: 118037
  derived and/or modified sequence opt2 from hemagglutinin__InfluenzaB__ACN32611

SEQ ID NO: 118074 - RNA, 1755 nt, Artificial Sequence; identical to SEQ ID NO: 117938
  derived and/or modified sequence opt2 from hemagglutinin__InfluenzaB__ACN32716

SEQ ID NO: 118075 - RNA, 1758 nt, Artificial Sequence; identical to SEQ ID NO: 118026
  derived and/or modified sequence opt2 from hemagglutinin__InfluenzaB__ACN32771

SEQ ID NO: 118076 - RNA, 1758 nt, Artificial Sequence; identical to SEQ ID NO: 118032
  derived and/or modified sequence opt2 from hemagglutinin__InfluenzaB__ACN32782

SEQ ID NO: 118077 - RNA, 1758 nt, Artificial Sequence
  derived and/or modified sequence opt2 from hemagglutinin__InfluenzaB__ACO05957
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118078 - RNA, 1755 nt, Artificial Sequence
  derived and/or modified sequence opt2 from hemagglutinin__InfluenzaB__ACO05968
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagcgcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118079 - RNA, 1755 nt, Artificial Sequence
  derived and/or modified sequence opt2 from hemagglutinin__InfluenzaB__ACO05979
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118080 - RNA, 1755 nt, Artificial Sequence; identical to SEQ ID NO: 118079
  derived and/or modified sequence opt2 from hemagglutinin__InfluenzaB__ACO05990

SEQ ID NO: 118081 - RNA, 1758 nt, Artificial Sequence
  derived and/or modified sequence opt2 from hemagglutinin__InfluenzaB__ACO06001
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagaaccagauggccaagcucuacggcgacuccaagccccagaaguucaccuccuucgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118082 - RNA, 1755 nt, Artificial Sequence; identical to SEQ ID NO: 118079
  derived and/or modified sequence opt2 from hemagglutinin__InfluenzaB__ACO06012

SEQ ID NO: 118083 - RNA, 1755 nt, Artificial Sequence; identical to SEQ ID NO: 118079
  derived and/or modified sequence opt2 from hemagglutinin__InfluenzaB__ACO06023

SEQ ID NO: 118084 - RNA, 1755 nt, Artificial Sequence
  derived and/or modified sequence opt2 from hemagglutinin__InfluenzaB__ACO06062
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucgacuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118085 - RNA, 1758 nt, Artificial Sequence
  derived and/or modified sequence opt2 from hemagglutinin__InfluenzaB__ACO94661
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucaccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118086 - RNA, 1758 nt, Artificial Sequence; identical to SEQ ID NO: 118026
  derived and/or modified sequence opt2 from hemagglutinin__InfluenzaB__ACR15622

SEQ ID NO: 118087 - RNA, 1758 nt, Artificial Sequence
  derived and/or modified sequence opt2 from hemagglutinin__InfluenzaB__ACR15633
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118088 - RNA, 1755 nt, Artificial Sequence
  derived and/or modified sequence opt2 from hemagglutinin__InfluenzaB__ACR15644
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118089 - RNA, 1758 nt, Artificial Sequence
  derived and/or modified sequence opt2 from hemagglutinin__InfluenzaB__ACR15655
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacaucuccugcuccaucugccucuga

SEQ ID NO: 118090 - RNA, 1758 nt, Artificial Sequence
  derived and/or modified sequence opt2 from hemagglutinin__InfluenzaB__ACR15666
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacaaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118091 - RNA, 1758 nt, Artificial Sequence
  derived and/or modified sequence opt2 from hemagglutinin__InfluenzaB__ACR15677
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacaucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118092 - RNA, 1755 nt, Artificial Sequence; identical to SEQ ID NO: 118079
  derived and/or modified sequence opt2 from hemagglutinin__InfluenzaB__ACR15710

SEQ ID NO: 118093 - RNA, 1755 nt, Artificial Sequence
  derived and/or modified sequence opt2 from hemagglutinin__InfluenzaB__ACR15721
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgccaccucccgcuccggcuucuucgccaccauggccugggccgucccccgcgacgacaacaagaccgccaccaacccccucaccgucgagguccccuacgucugcaccgagggcgaggaccagaucaccgucuggggcuuccacuccgacaacaaggcccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118094 - RNA, 1758 nt, Artificial Sequence
  derived and/or modified sequence opt2 from hemagglutinin__InfluenzaB__ACR39336
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118095 - RNA, 1755 nt, Artificial Sequence
  derived and/or modified sequence opt2 from hemagglutinin__InfluenzaB__AEA51386
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacuacaagaacgccaccaacccccucaccgucgagguccccuacaucugcaccgagggcgagggccagaucaccgucuggggcuuccacuccgacaacaagccccagaugaagaaccucuacggcgacuccaacccccagaaguucaccuccuccgccuccggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaucaccccccagaagcucgccaacggcaccaccuucuccccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118096 - RNA, 1755 nt, Artificial Sequence
  derived and/or modified sequence opt2 from hemagglutinin__InfluenzaB__AEA51387
augaaggccaucaucguccuccucauggucgucaccuccaacgccgaccgcaucugcaccgagaucaccuccuccaacuccccccucgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggccccaucgucuaccagcgcggcguccuccucccccagaaggucuggugcgccuccggccgcuccaaggucaucaagggcucccucccccucaucggcgaggccgacugccuccacgagaaguacggcggccucaacaaguccaaguacucccacaccggcgaccacgccaagacccucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118097 - RNA, 1755 nt, Artificial Sequence
  derived and/or modified sequence opt2 from hemagglutinin__InfluenzaB__AEA51388
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuccuacaccggcgagcacgccaaggccaagggcaacugccccaucugggucaacaccccccucaagcucgccaacggcaccaaguaccgcccccccgccaagcucuucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaagggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118098 - RNA, 1755 nt, Artificial Sequence
  derived and/or modified sequence opt2 from hemagglutinin__InfluenzaB__AEA51389
augaaggccaucaucguccuccucauggucgucaccuccaacgccgaccgcaucugcaccggcaucaccuccuccaucuccccccucgucgacaagaccgccacccagggcgaggucaacgucaccggcgucaucccccucaccaccacccccaccaaguccuacuucgccaacgucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgcccagaaggcccccggcggccccuaccgccucggcaccuccggcuccugccccaacgccaccuccaagaucggcuucuucgccaccauggccugcgccguccccaaggacaacuacaagaacgccaccaacccccucaccgucgagguccccuacauccgcaccgagggcgaggaccagaucaccgucuggggcuuccacuccgacaacaagacccagaugaagaaccucuacggcgacuccaacccccccaaguucaccuccuccgccaacggcgucaccacccacuacgucucccagaccggcgacuuccccgaccagaccgaggacggcggccucccccccuccggccgcaucgucgucgacuacaugaugcagaagcccggcaagaccggcaccaucgccuaccagcgcggcguccuccucccccagaaggucuggugcgccuccggccgcuccaaggucaucaagggcucccucccccucaucggcgaggccgacugccuccacgagaaguacggcggccucaacaaguccaagcccccccacaccggcgagcacaccaaggccaucggcaacugccccaucugggucaagaccccccucaagcucgccaacggcaccaaguaccgccccuccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucuuccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118099 - RNA, 1755 nt, Artificial Sequence
  derived and/or modified sequence opt2 from hemagglutinin__InfluenzaB__AEA51390
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccccuccggccgcaucgucgucgacuacaugaugcagaagcccggcaagaccggcaccaucgucuaccagcgcggcggccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagcccccccucaagcucgccaacggcaccaaguaccgcccccccgccaagcucuucaaggagcgcggcuucuucggcgcccucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118100 - RNA, 1758 nt, Artificial Sequence
  derived and/or modified sequence opt2 from hemagglutinin__InfluenzaB__AEA51391
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgucaacgagacccagauggccaagcucuacggcgacuccaagccccagaaguucaccuccuccgccaacggcgucaccacccacuacaucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcguccccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118101 - RNA, 1758 nt, Artificial Sequence
  derived and/or modified sequence opt2 from hemagglutinin__InfluenzaB__AEA51392
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcggcaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaagaacaucgcccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118102 - RNA, 1755 nt, Artificial Sequence
  derived and/or modified sequence opt2 from hemagglutinin__InfluenzaB__AEA51395
augaaggccaucaucguccuccucauggucgucaccuccaacgccgaccgcaucugcaccggcaucaccuccuccaacuccccccacgucgucaagaccgccacccucggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccaguucaccgucuggggcuuccacuccgacaacaucacccagcucaagaaccucuucggcgacuccaacccccagcgcuucaccuccuccgccaacggcgucaccacccacuacgucucccagaucggcgacuuccccgaccagaccgaggacggcggccucccccaguccggccgcaucgucgucgacuacgucaugcagaagcccggcaagaccggcaccaucgucuaccagcgcggcguccuccucccccccaaggucugguucgcccgcggccgcuccaaggucaucaagggcucccucccccucaucggcgaggccgacugcauccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118103 - RNA, 1758 nt, Artificial Sequence
  derived and/or modified sequence opt2 from hemagglutinin__InfluenzaB__AEA51398
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaucggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaaguccuacuacaccggcgagcacgccaaggccaucggcaacugccccaucugggucaagaccccccucaagcucgccaacggcaccaaguaccgcccccccgcccaccucuccuacuucugcggcuucuucggcgccaucgccggcuuccucgagggcggcugggagggcaugaucgccggcuggaacggcuacaccucccacggcgcccacggcgucgccgucgucgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118104 - RNA, 1758 nt, Artificial Sequence
  derived and/or modified sequence opt2 from hemagglutinin__InfluenzaB__AEA51399
augaaggccaucaucguccuccucauggucgucaccuccaacgccgaccgcaucugcaccggcaucaccgccucccagucccccaacaucgacaaguccuccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaucggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaaguccuacuacaccggcgagcacgccaaggccaucggcaacugccccaucugggucaagaccccccucaagcucgccaacggcaccaaguaccgcccccccgcccaccucuccuacuucugcggcuucuucggcgccaucgccggcuuccucgagggcggcugggagggcaugaucgccggcuggaacggcuacaccucccacggcgcccacggcgucgccgucgucgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118105 - RNA, 1758 nt, Artificial Sequence
  derived and/or modified sequence opt2 from hemagglutinin__InfluenzaB__AEG21014
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccuccacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaugggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucauggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118106 - RNA, 1755 nt, Artificial Sequence
  derived and/or modified sequence opt2 from hemagglutinin__InfluenzaB__AEG21015
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaacggcuucuucgccaccauggccugggccguccccaaggacaacuacaagggcgccaccaaccccaagaccgucgagguccccuacaucugcaccgagggcgagggccagaucaccgucuggggcuuccacuccgacaacaagccccagaugaagaaccucuacggcgacuccaacccccagaaguucaccuccuccgccuccggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaucaccccccagaagcucgccaacggcaccaccuucuccccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118107 - RNA, 1755 nt, Artificial Sequence
  derived and/or modified sequence opt2 from hemagglutinin__InfluenzaB__AEG21016
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagcgcgccaccaaccccaagaccgucgagguccccuacaucugcaccgagggcgaggaccagaucaccgucuggggcuuccacuccgacaacaagccccagaugaagaaccccuacggcgacuccaacccccagaaguucaccuccuccgccuccggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118108 - RNA, 1755 nt, Artificial Sequence
  derived and/or modified sequence opt2 from hemagglutinin__InfluenzaB__AEG21017
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuccuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118109 - RNA, 1755 nt, Artificial Sequence
  derived and/or modified sequence opt2 from hemagglutinin__InfluenzaB__AEG21018
augaaggccaucaucguccuccucauggucgucaccuccaacgccgaccgcaucugcaccggcaucaccuccuccaucuccccccucgucgacaagaccgccacccagggcgaggucaacgucaccggcgucaucccccucaccaccacccccaccaaguccuacuucgccaacgucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgcccagaaggcccccggcggccccuaccgccucggcaccuccggcuccugccccaacgccaccuccaagaucggcuucuucgccaccauggccugcgccguccccaaggacaacuacaagaacgccaccaacccccucaccgucgagguccccuacauccgcaccgagggcgaggaccagaucaccgucuggggcuuccacuccgacaacaagacccagaugaagaaccucuacggcgacuccaacccccccaaguucaccuccuccgccaacggcgucaccacccacuacgucucccagaccggcgacuuccccgaccagaccgaggacggcggccucccccccuccggccgcaucgucgucgacuacaugaugcagaagcccggcaagaccggccccaucgccuaccagcgcggcguccuccucccccagaaggucuggugcgccuccggccgcuccaaggucaucaagggcucccucccccucaucggcgaggccgacugccuccacgagaaguacggcggccucaacaaguccaaguacucccacaccggcgaccacgccaagacccucggcaacugccccaucugggucaagaccccccucaagcucgccaacggcaccaaguaccgccccuccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118110 - RNA, 1755 nt, Artificial Sequence
  derived and/or modified sequence opt2 from hemagglutinin__InfluenzaB__AEG21019
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaccggcgacuuccccgaccagaccgaggacggcggccucccccccuccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuccuacaccggcgagcacgccaaggccaucggcaacugccccaucugggucaagaccccccucaagcucgccaacggcaccaaguaccgccccuccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118111 - RNA, 1758 nt, Artificial Sequence
  derived and/or modified sequence opt2 from hemagglutinin__InfluenzaB__AEG21021
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccauccuccacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucuccaucgagguccccuacaucugcaccgagggcgaggaccagaucaccgucuggggcuuccacuccgacaacgagacccagauggccaagcucuacggcgacuccaagccccagaaguucaccuccuccgccaacggcgucgccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucuucggcgaggccgacugccuccacgagaaguacggcggcuucaacaaguccaagcccuacuacaccggcgagcacgccaaggccaucggcaacugccccaucugggucaagaccccccucaagcucgccaacggcaccaaguaccgcccccccgccaagcucuucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118112 - RNA, 1758 nt, Artificial Sequence
  derived and/or modified sequence opt2 from hemagglutinin__InfluenzaB__AEG21022
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaccacccccuccgcccgcgccuccauccuccacgagguccgccccgucaccuccggcugcuuccccauccuccacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucuccgucgagguccccuacaucugcaccgagggcgaggaccagaucaccgucuggggcuuccacuccgacaacgagacccagauggccaagcucuacggcgacuccaagccccagaaguucaccuccuccgccaacggcgucgccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagcgcggcuggugcgccuccggccgcuccaaggucaucaagggcucccucccccucuucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcucuucaaggagcgcggcuucuucggcgccaucgccggcuuccucgagggcggcugggagggcaugaucgccggcuggcacggcuacaccucccacggcgcccacggcguccccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118113 - RNA, 1755 nt, Artificial Sequence
  derived and/or modified sequence opt2 from hemagglutinin__InfluenzaB__AEG21023
augaaggccaucaucguccuccucauggucgucaccuccaacgccgaccgcaucugcaccggcaucaccuccuccaacuccccccacgucgucaagaccgccacccucggcgaggucaacgagaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcguccccacccacuacgucucccagaucggcgacuuccccgaccccaccgaggacggcggccucccccaguccggccgcaucggcgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucuccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugcuccgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118114 - RNA, 1758 nt, Artificial Sequence
  derived and/or modified sequence opt2 from hemagglutinin__InfluenzaB__AEG21024
augaaggccaucaucguccuccucauggucgucaccuccaacgccgaccgcaucugcaccggcaucaccuccuccuccuccccccacgucgucaagaccgccacccagggcgaggucaacgucaccggcgucaucccccucaccaccacccccaccaaguccuacuucgccaaccucaagggcaccgagacccgcggcaagcucugccccgacugccccaacugcaccgaccucgacgucgcccucggccgccccaacugcuggggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaaggacgacaagaacaacgccgccacccaccuccucaccaucgagguccccuucuucugcaccggcggcgagcaccacaucgccgucuggggcuuccccuccgacaacgacacccucauggccaagcucuucggcgacuccaacccccagauguucuccuccuccgccaacggcaccaccacccacuacgucucccagaucggcggcuuccccaaccagaccgaggacggcggccucccccaguccggccgcaucgucgucgacuacaugguccagaaguccggcaagaccggcaccaucgccuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118115 - RNA, 1755 nt, Artificial Sequence
  derived and/or modified sequence opt2 from hemagglutinin__InfluenzaB__AEG21025
augaaggccaucaucguccuccucauggucgucaccuccaacgccgaccgcaucugcaccggcaucaccuccuccaacuccccccacgucgucaagaccgccacccucggcgaggucaacgagaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaucaagacccagaugaagaaccucuacggcgacuccaacccccagaaguucaccuccuccgccaacggcguccccacccacuacgucucccagaucggcgacuuccccgaccccaccgaggacggcggccucccccaguccggccgcaucggcgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucuccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugcuccgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118116 - RNA, 1758 nt, Artificial Sequence
  derived and/or modified sequence opt2 from hemagglutinin__InfluenzaB__AEG21026
augaaggccaugaugguccuccucauggucgucaccuccaacgccgaccgcaucugcaccggcaucaccuccuccaacuccccccacgucgucaagaccgccacccagggcgaggucaacgucaccggcgucaucccccucaccaucacccccaccaagucccacuucgccaaccucaaggucaaggagacccgcggcaagcucugccccaagugccccaacugcaccgaccucgacgucgcccucggccgccccaagugcaccggcaagauccccuccgcccgcgucuccauccuccacgaggacacccccgucaccuccggcugcauccccaucaugcacgaccgcaccaagauccgccagcuccccaaccuccuccgcggcuacgagcacauccgccucuccacccacaacgucaucaacgccgaguccgcccccggcggccccuacaagaucggcaccuccggcuccugccccaacgucaccaacggcaucggcuucuucgccaccauggccugggccguccccaagaacgacaagaacaagaccgccaccaacccccucaccaucgagguccccuacaucugcaccgagggcgaggaccagaucaccgucuggggcuuccacuucgacaacgagacccagauggccaagcucuacggcgacuccaagccccaggucuucaccuccuccgccaacggcgucaacgccgacuucgucucccagauccgcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaaggagucccucccccucaucggcgaggccuacuuccagcaggaggaguacggcggccucaacaaguccaaguccuacuacaccgaggagcacgccaaggccaucggcaucugccccaucugggucaagaccccccucaagcucgccaacaagaccaaguaccgcccccccgcccaccucuccuacuucugcggcuucuucggcgccaucgccggcuuccucgagggcggcugggagggcaugaucgccggcuggaacggcuacaccucccacggcgcccacggcgucgccgucgucgccgaccucaaguccacccaggaggccaucaacaagaucaccaagaaccucaacucccucuccgagcucgaggucgagacccuccagcgccucuccggcgccauggacgagcuccacaacgagauccucgagcucgacgagaaggucgacgaccaccgcgccgacaccaucuccucccagaucgagcuccccgaccagcucuccaacgacggcuccaucaacuccgaggacgagcaccuccucgcccucgagcgcaagcucaagaagaugcucggccccuccaacggcgacaagggcuccggcggcaucgagaccaagcacaagugcaaccagaccugccucgaccgcaucgccgccggcaccuucgacgccggcggcuucucccaccccaccuucgacuccaagaacgucaccgccgccucccucaacgacgacggccucgacuccggcaccauccuccucuacuacuccaccgacgucuccaaccucgccgucaccgucaugaugggcaucuucgucaaguacauggucucccgcgacaacgucuccugcuccaucugccucuga

SEQ ID NO: 118117 - RNA, 1758 nt, Artificial Sequence
  derived and/or modified sequence opt2 from hemagglutinin__InfluenzaB__AEG21027
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaucacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaucggcuucuucgccaccauggccugggccguccccaagaacgacaagaacaagaccgccaccaacccccucaccaucgagguccccuacaucugcaccgagggcgaggaccagaucaccgucuggggcuuccacuucgacaacgagacccagauggccaagcucuacggcgacuccaagccccagaaguucaccuccuccgccaacggcgucaacgccgacuucgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaaggagucccucccccucaucggcgaggccuacuuccagcaggaggaguacggcggccucaacaaguccaaguccuacuacaccggcgagcacgccaaggccaucggcaacugccccaucugggucaagaccccccucaagcucgccaacggcaccaaguaccgcccccccgcccaccucuccuacuucugcggcuucuucggcgccaucgccggcuuccucgagggcggcugggagggcaugaucgccggcuggaacggcuacaccucccacggcgcccacggcgucgccgucgucgccgaccucaaguccacccaggaggccaucaacaagaucaccaagaaccucaacucccucuccgagcucgaggucgagacccuccagcgccucuccggcgccauggacgagcuccacaacgagauccucgagaucgacgagaaggucgacgaccaccgcgccgacaccaucuccucccagaucgagcucgccguccuccucuccaacgagggcaucaucaacuccgaggacgagcaccuccucgcccucgagcgcaagcucaagaagaugcucggccccuccaacggcgacaagggcuccggcggcaucgagaccaagcacaagugcaaccagaccugccucgaccgcaucgccgccggcaccuucgacgccggcgaguucucccuccccaccuucgacucccucaacaucaccgccgccucccucaacgacgacggccucgacuccggcaccauccuccucuacuacuccaccgacgucuccaaccucgccgucaccgucaugaugggcaucuucgucaaguacauggucucccgcgacaacgucuccugcuccaucugccucuga

SEQ ID NO: 118118 - RNA, 1758 nt, Artificial Sequence
  derived and/or modified sequence opt2 from hemagglutinin__InfluenzaB__AEG21028
augaaggccaucaucguccuccucauggucgucaccuccaacgccgaccgcaucugcaccggcaucaccgccucccagucccccaacaucgacaaguccuccacccagggcgaggucaacgucuccugcgucaucccccucaccaccacccccaccaagucccacuucgccaaccucaaggucaaggagacccgcggcaagcucugccccaagugccccaacugcaccgaccucgacgucucccucggccgccccaagugcaccggcaagauccccuccgcccgcgucuccauccuccacgagguccgccccgucgccuccggcggcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaucggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgccgccaagcgccccugcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaaguccuacuacaccggcgagcacgccaaggccaucggcaacugccccaucugggucaagaccccccucaagcucgccucccgcaccauguccaagacccccgcccaccucuccuacuucugcggcuucuucggcgccaucgccggcuuccucgagggcggcugggagggcaugaucgccggcuggaacggcuacaccucccacggcgcccacggcgucgccgucgucgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118119 - RNA, 1758 nt, Artificial Sequence
  derived and/or modified sequence opt2 from hemagglutinin__InfluenzaB__AEG21029
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaucggcuucuucgccaccauggccugggccguccccaagaacgacaagaacaagaccgccaccaacccccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118120 - RNA, 1758 nt, Artificial Sequence
  derived and/or modified sequence opt2 from hemagglutinin__InfluenzaB__AEO80052
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118121 - RNA, 1758 nt, Artificial Sequence; identical to SEQ ID NO: 118026
  derived and/or modified sequence opt2 from hemagglutinin__InfluenzaB__AEO80067

SEQ ID NO: 118122 - RNA, 1755 nt, Artificial Sequence
  derived and/or modified sequence opt2 from hemagglutinin__InfluenzaB__AEO80078
augaaggagaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118123 - RNA, 1758 nt, Artificial Sequence
  derived and/or modified sequence opt2 from hemagglutinin__InfluenzaB__AEO80086
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118124 - RNA, 1755 nt, Artificial Sequence
  derived and/or modified sequence opt2 from hemagglutinin__InfluenzaB__AEO80097
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118125 - RNA, 1755 nt, Artificial Sequence; identical to SEQ ID NO: 117938
  derived and/or modified sequence opt2 from hemagglutinin__InfluenzaB__AEO80108

SEQ ID NO: 118126 - RNA, 1758 nt, Artificial Sequence; identical to SEQ ID NO: 118026
  derived and/or modified sequence opt2 from hemagglutinin__InfluenzaB__AEO80145

SEQ ID NO: 118127 - RNA, 1758 nt, Artificial Sequence; identical to SEQ ID NO: 118085
  derived and/or modified sequence opt2 from hemagglutinin__InfluenzaB__AEO80154

SEQ ID NO: 118128 - RNA, 1758 nt, Artificial Sequence
  derived and/or modified sequence opt2 from hemagglutinin__InfluenzaB__AEO80183
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaucgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118129 - RNA, 1758 nt, Artificial Sequence
  derived and/or modified sequence opt2 from hemagglutinin__InfluenzaB__AEO80194
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgcccgcggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacaugaucucccgcgacaacgucuccugcuccaucugccucuga

SEQ ID NO: 118130 - RNA, 1758 nt, Artificial Sequence; identical to SEQ ID NO: 118077
  derived and/or modified sequence opt2 from hemagglutinin__InfluenzaB__AEO80205

SEQ ID NO: 118131 - RNA, 1758 nt, Artificial Sequence; identical to SEQ ID NO: 118077
  derived and/or modified sequence opt2 from hemagglutinin__InfluenzaB__AEO80216

SEQ ID NO: 118132 - RNA, 1755 nt, Artificial Sequence
  derived and/or modified sequence opt2 from hemagglutinin__InfluenzaB__AEO80227
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118133 - RNA, 1758 nt, Artificial Sequence; identical to SEQ ID NO: 118094
  derived and/or modified sequence opt2 from hemagglutinin__InfluenzaB__AEO80238

SEQ ID NO: 118134 - RNA, 1758 nt, Artificial Sequence
  derived and/or modified sequence opt2 from hemagglutinin__InfluenzaB__AEP20178
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucuccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118135 - RNA, 1758 nt, Artificial Sequence
  derived and/or modified sequence opt2 from hemagglutinin__InfluenzaB__AEP20189
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccguccuccucuacuacuccaccgccgccuccucccucgccgucacccucaugaucgccaucuucgucgucuacauggucucccgcgacaacgucuccugcuccaucugccucuga

SEQ ID NO: 118136 - RNA, 1758 nt, Artificial Sequence; identical to SEQ ID NO: 118026
  derived and/or modified sequence opt2 from hemagglutinin__InfluenzaB__AEP20200

SEQ ID NO: 118137 - RNA, 1755 nt, Artificial Sequence; identical to SEQ ID NO: 117917
  derived and/or modified sequence opt2 from hemagglutinin__InfluenzaB__AEP20211

SEQ ID NO: 118138 - RNA, 1755 nt, Artificial Sequence
  derived and/or modified sequence opt2 from hemagglutinin__InfluenzaB__AEP20222
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugcuucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgagguccccaacaucugcaccaaggaggaggaccagaucaccgucuggggcuuccacuccgacaacaagacccagaugaagaaccucuacggcgaccccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118139 - RNA, 1755 nt, Artificial Sequence; identical to SEQ ID NO: 118023
  derived and/or modified sequence opt2 from hemagglutinin__InfluenzaB__AEP20233

SEQ ID NO: 118140 - RNA, 1755 nt, Artificial Sequence
  derived and/or modified sequence opt2 from hemagglutinin__InfluenzaB__AEP20244
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugcuucaacugcaccgaccucgacgucgcccucggccgccccaugugcaugggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccgucccccgcggcaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118141 - RNA, 1758 nt, Artificial Sequence; identical to SEQ ID NO: 117931
  derived and/or modified sequence opt2 from hemagglutinin__InfluenzaB__AEP20255

SEQ ID NO: 118142 - RNA, 1758 nt, Artificial Sequence
  derived and/or modified sequence opt2 from hemagglutinin__InfluenzaB__AEP20277
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgacaagaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118143 - RNA, 1755 nt, Artificial Sequence
  derived and/or modified sequence opt2 from hemagglutinin__InfluenzaB__AEP20299
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaagaacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118144 - RNA, 1755 nt, Artificial Sequence
  derived and/or modified sequence opt2 from hemagglutinin__InfluenzaB__AEP20310
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccgcccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118145 - RNA, 1758 nt, Artificial Sequence
  derived and/or modified sequence opt2 from hemagglutinin__InfluenzaB__AEP20332
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118146 - RNA, 1755 nt, Artificial Sequence; identical to SEQ ID NO: 117938
  derived and/or modified sequence opt2 from hemagglutinin__InfluenzaB__AEP20343

SEQ ID NO: 118147 - RNA, 1755 nt, Artificial Sequence; identical to SEQ ID NO: 117938
  derived and/or modified sequence opt2 from hemagglutinin__InfluenzaB__AEP20354

SEQ ID NO: 118148 - RNA, 1755 nt, Artificial Sequence; identical to SEQ ID NO: 117938
  derived and/or modified sequence opt2 from hemagglutinin__InfluenzaB__AEP20365

SEQ ID NO: 118149 - RNA, 1755 nt, Artificial Sequence; identical to SEQ ID NO: 117938
  derived and/or modified sequence opt2 from hemagglutinin__InfluenzaB__AEP20376

SEQ ID NO: 118150 - RNA, 1758 nt, Artificial Sequence
  derived and/or modified sequence opt2 from hemagglutinin__InfluenzaB__AEP20398
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118151 - RNA, 1758 nt, Artificial Sequence; identical to SEQ ID NO: 118120
  derived and/or modified sequence opt2 from hemagglutinin__InfluenzaB__AEP20409

SEQ ID NO: 118152 - RNA, 1758 nt, Artificial Sequence; identical to SEQ ID NO: 118120
  derived and/or modified sequence opt2 from hemagglutinin__InfluenzaB__AEP20420

SEQ ID NO: 118153 - RNA, 1758 nt, Artificial Sequence; identical to SEQ ID NO: 118120
  derived and/or modified sequence opt2 from hemagglutinin__InfluenzaB__AEP20431

SEQ ID NO: 118154 - RNA, 1758 nt, Artificial Sequence; identical to SEQ ID NO: 118120
  derived and/or modified sequence opt2 from hemagglutinin__InfluenzaB__AEP20442

SEQ ID NO: 118155 - RNA, 1758 nt, Artificial Sequence; identical to SEQ ID NO: 118120
  derived and/or modified sequence opt2 from hemagglutinin__InfluenzaB__AEP20453

SEQ ID NO: 118156 - RNA, 1755 nt, Artificial Sequence; identical to SEQ ID NO: 117938
  derived and/or modified sequence opt2 from hemagglutinin__InfluenzaB__AEQ39027

SEQ ID NO: 118157 - RNA, 1758 nt, Artificial Sequence
  derived and/or modified sequence opt2 from hemagglutinin__InfluenzaB__AEQ39260
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118158 - RNA, 1758 nt, Artificial Sequence; identical to SEQ ID NO: 118157
  derived and/or modified sequence opt2 from hemagglutinin__InfluenzaB__AEQ39271

SEQ ID NO: 118159 - RNA, 1758 nt, Artificial Sequence
  derived and/or modified sequence opt2 from hemagglutinin__InfluenzaB__AEQ39282
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacggcgacgagcucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118160 - RNA, 1758 nt, Artificial Sequence
  derived and/or modified sequence opt2 from hemagglutinin__InfluenzaB__AEQ39315
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacggcgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118161 - RNA, 1758 nt, Artificial Sequence; identical to SEQ ID NO: 118160
  derived and/or modified sequence opt2 from hemagglutinin__InfluenzaB__AEQ39326

SEQ ID NO: 118162 - RNA, 1758 nt, Artificial Sequence
  derived and/or modified sequence opt2 from hemagglutinin__InfluenzaB__AEQ39337
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccggcaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaagccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118163 - RNA, 1758 nt, Artificial Sequence
  derived and/or modified sequence opt2 from hemagglutinin__InfluenzaB__AEQ39348
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaucauccuccucuacuacuccaccgccgccuccucccucgccgucacccucaugaucgccaucuucgucgucuacauggucucccgcgacaacgucuccugcuccaucugccucuga

SEQ ID NO: 118164 - RNA, 1758 nt, Artificial Sequence; identical to SEQ ID NO: 118160
  derived and/or modified sequence opt2 from hemagglutinin__InfluenzaB__AEQ39359

SEQ ID NO: 118165 - RNA, 1758 nt, Artificial Sequence
  derived and/or modified sequence opt2 from hemagglutinin__InfluenzaB__AEQ39370
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucgucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118166 - RNA, 1755 nt, Artificial Sequence; identical to SEQ ID NO: 117938
  derived and/or modified sequence opt2 from hemagglutinin__InfluenzaB__AEQ39392

SEQ ID NO: 118167 - RNA, 1755 nt, Artificial Sequence; identical to SEQ ID NO: 117938
  derived and/or modified sequence opt2 from hemagglutinin__InfluenzaB__AEQ39429

SEQ ID NO: 118168 - RNA, 1755 nt, Artificial Sequence; identical to SEQ ID NO: 117938
  derived and/or modified sequence opt2 from hemagglutinin__InfluenzaB__AEQ39440

SEQ ID NO: 118169 - RNA, 1755 nt, Artificial Sequence; identical to SEQ ID NO: 117938
  derived and/or modified sequence opt2 from hemagglutinin__InfluenzaB__AEQ39451

SEQ ID NO: 118170 - RNA, 1758 nt, Artificial Sequence; identical to SEQ ID NO: 118150
  derived and/or modified sequence opt2 from hemagglutinin__InfluenzaB__AEQ39462

SEQ ID NO: 118171 - RNA, 1758 nt, Artificial Sequence; identical to SEQ ID NO: 118157
  derived and/or modified sequence opt2 from hemagglutinin__InfluenzaB__AEQ39484

SEQ ID NO: 118172 - RNA, 1755 nt, Artificial Sequence; identical to SEQ ID NO: 117917
  derived and/or modified sequence opt2 from hemagglutinin__InfluenzaB__AEQ39506

SEQ ID NO: 118173 - RNA, 1758 nt, Artificial Sequence
  derived and/or modified sequence opt2 from hemagglutinin__InfluenzaB__AEQ39517
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacaacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118174 - RNA, 1758 nt, Artificial Sequence
  derived and/or modified sequence opt2 from hemagglutinin__InfluenzaB__AER27038
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccaagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcaucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118175 - RNA, 1758 nt, Artificial Sequence; identical to SEQ ID NO: 118120
  derived and/or modified sequence opt2 from hemagglutinin__InfluenzaB__AER27060

SEQ ID NO: 118176 - RNA, 1758 nt, Artificial Sequence
  derived and/or modified sequence opt2 from hemagglutinin__InfluenzaB__AET10061
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccaagaacgcccccggcggccccuacaagaucggcaccuccggcuccugccccaacgucaccaacggcaacggcuucuucgccaccauggccugggccguccccaagaacgacaagaaccgcaccgccaccaacucccucaccaucgagguccccuacaucugcaaggagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118177 - RNA, 1755 nt, Artificial Sequence
  derived and/or modified sequence opt2 from hemagglutinin__InfluenzaB__AET10062
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaucacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118178 - RNA, 1755 nt, Artificial Sequence
  derived and/or modified sequence opt2 from hemagglutinin__InfluenzaB__AET10064
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccaucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118179 - RNA, 1755 nt, Artificial Sequence
  derived and/or modified sequence opt2 from hemagglutinin__InfluenzaB__AET10065
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118180 - RNA, 1755 nt, Artificial Sequence; identical to SEQ ID NO: 118179
  derived and/or modified sequence opt2 from hemagglutinin__InfluenzaB__AET10066

SEQ ID NO: 118181 - RNA, 1755 nt, Artificial Sequence
  derived and/or modified sequence opt2 from hemagglutinin__InfluenzaB__AET10067
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccgccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118182 - RNA, 1755 nt, Artificial Sequence
  derived and/or modified sequence opt2 from hemagglutinin__InfluenzaB__AET10068
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccgcccccaccaaguccuacuucgccaaccucaagggcacccgcacccgcggcaagcucugccccgacugccucaacugcaccgaccucgacgucgcccucggccgccccaugugcgccggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118183 - RNA, 1755 nt, Artificial Sequence; identical to SEQ ID NO: 118179
  derived and/or modified sequence opt2 from hemagglutinin__InfluenzaB__AET10069

SEQ ID NO: 118184 - RNA, 1758 nt, Artificial Sequence
  derived and/or modified sequence opt2 from hemagglutinin__InfluenzaB__AET10070
augaaggccaucaucguccuccucauggucgucaccuccaacgccgaccgcaucugcaccggcaucaccuccuccaacuccccccacgucgucaagaccgccacccagggcgaggucaaggucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118185 - RNA, 1758 nt, Artificial Sequence; identical to SEQ ID NO: 118120
  derived and/or modified sequence opt2 from hemagglutinin__InfluenzaB__AET10071

SEQ ID NO: 118186 - RNA, 1758 nt, Artificial Sequence; identical to SEQ ID NO: 118120
  derived and/or modified sequence opt2 from hemagglutinin__InfluenzaB__AET10072

SEQ ID NO: 118187 - RNA, 1755 nt, Artificial Sequence
  derived and/or modified sequence opt2 from hemagglutinin__InfluenzaB__AET10073
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcugcgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118188 - RNA, 1758 nt, Artificial Sequence
  derived and/or modified sequence opt2 from hemagglutinin__InfluenzaB__AET10074
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccacccgcucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggccgcaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucgacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118189 - RNA, 1758 nt, Artificial Sequence; identical to SEQ ID NO: 118120
  derived and/or modified sequence opt2 from hemagglutinin__InfluenzaB__AET10076

SEQ ID NO: 118190 - RNA, 1758 nt, Artificial Sequence; identical to SEQ ID NO: 118120
  derived and/or modified sequence opt2 from hemagglutinin__InfluenzaB__AET10077

SEQ ID NO: 118191 - RNA, 1758 nt, Artificial Sequence
  derived and/or modified sequence opt2 from hemagglutinin__InfluenzaB__AET10078
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccguccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgaggacggccucgacaaccacgccauccuccucuacuacuccaccgccgccuccucccucgccgucacccucaugaucgccaucuucgucgucuacauggucucccgcgacaacgucuccugcuccaucugccucuga

SEQ ID NO: 118192 - RNA, 1758 nt, Artificial Sequence
  derived and/or modified sequence opt2 from hemagglutinin__InfluenzaB__AET10079
augaaggccaucaucguccuccucauggucgucaccuccaacgccgacggcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucaccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucgagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118193 - RNA, 1758 nt, Artificial Sequence; identical to SEQ ID NO: 118120
  derived and/or modified sequence opt2 from hemagglutinin__InfluenzaB__AET10080

SEQ ID NO: 118194 - RNA, 1758 nt, Artificial Sequence; identical to SEQ ID NO: 118120
  derived and/or modified sequence opt2 from hemagglutinin__InfluenzaB__AET10081

SEQ ID NO: 118195 - RNA, 1758 nt, Artificial Sequence
  derived and/or modified sequence opt2 from hemagglutinin__InfluenzaB__AET10082
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118196 - RNA, 1758 nt, Artificial Sequence
  derived and/or modified sequence opt2 from hemagglutinin__InfluenzaB__AET10083
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagguccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118197 - RNA, 1758 nt, Artificial Sequence; identical to SEQ ID NO: 118157
  derived and/or modified sequence opt2 from hemagglutinin__InfluenzaB__AET10084

SEQ ID NO: 118198 - RNA, 1758 nt, Artificial Sequence; identical to SEQ ID NO: 118120
  derived and/or modified sequence opt2 from hemagglutinin__InfluenzaB__AET10085

SEQ ID NO: 118199 - RNA, 1758 nt, Artificial Sequence; identical to SEQ ID NO: 118160
  derived and/or modified sequence opt2 from hemagglutinin__InfluenzaB__AET43124

SEQ ID NO: 118200 - RNA, 1758 nt, Artificial Sequence; identical to SEQ ID NO: 118160
  derived and/or modified sequence opt2 from hemagglutinin__InfluenzaB__AET43135

SEQ ID NO: 118201 - RNA, 1758 nt, Artificial Sequence; identical to SEQ ID NO: 118160
  derived and/or modified sequence opt2 from hemagglutinin__InfluenzaB__AET43146

SEQ ID NO: 118202 - RNA, 1758 nt, Artificial Sequence; identical to SEQ ID NO: 118160
  derived and/or modified sequence opt2 from hemagglutinin__InfluenzaB__AET43157

SEQ ID NO: 118203 - RNA, 1758 nt, Artificial Sequence
  derived and/or modified sequence opt2 from hemagglutinin__InfluenzaB__AET43168
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucacccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118204 - RNA, 1758 nt, Artificial Sequence; identical to SEQ ID NO: 118160
  derived and/or modified sequence opt2 from hemagglutinin__InfluenzaB__AET43179

SEQ ID NO: 118205 - RNA, 1758 nt, Artificial Sequence; identical to SEQ ID NO: 118160
  derived and/or modified sequence opt2 from hemagglutinin__InfluenzaB__AET43190

SEQ ID NO: 118206 - RNA, 1758 nt, Artificial Sequence
  derived and/or modified sequence opt2 from hemagglutinin__InfluenzaB__AET43201
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccggcaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118207 - RNA, 1758 nt, Artificial Sequence; identical to SEQ ID NO: 118160
  derived and/or modified sequence opt2 from hemagglutinin__InfluenzaB__AET43212

SEQ ID NO: 118208 - RNA, 1758 nt, Artificial Sequence; identical to SEQ ID NO: 118160
  derived and/or modified sequence opt2 from hemagglutinin__InfluenzaB__AET43223

SEQ ID NO: 118209 - RNA, 1758 nt, Artificial Sequence; identical to SEQ ID NO: 118206
  derived and/or modified sequence opt2 from hemagglutinin__InfluenzaB__AET50943

SEQ ID NO: 118210 - RNA, 1758 nt, Artificial Sequence; identical to SEQ ID NO: 118160
  derived and/or modified sequence opt2 from hemagglutinin__InfluenzaB__AET50954

SEQ ID NO: 118211 - RNA, 1758 nt, Artificial Sequence; identical to SEQ ID NO: 118160
  derived and/or modified sequence opt2 from hemagglutinin__InfluenzaB__AET50965

SEQ ID NO: 118212 - RNA, 1758 nt, Artificial Sequence; identical to SEQ ID NO: 118160
  derived and/or modified sequence opt2 from hemagglutinin__InfluenzaB__AET50976

SEQ ID NO: 118213 - RNA, 1758 nt, Artificial Sequence; identical to SEQ ID NO: 118160
  derived and/or modified sequence opt2 from hemagglutinin__InfluenzaB__AET74255

SEQ ID NO: 118214 - RNA, 1758 nt, Artificial Sequence; identical to SEQ ID NO: 118206
  derived and/or modified sequence opt2 from hemagglutinin__InfluenzaB__AET74277

SEQ ID NO: 118215 - RNA, 1758 nt, Artificial Sequence; identical to SEQ ID NO: 118160
  derived and/or modified sequence opt2 from hemagglutinin__InfluenzaB__AET74288

SEQ ID NO: 118216 - RNA, 1758 nt, Artificial Sequence
  derived and/or modified sequence opt2 from hemagglutinin__InfluenzaB__AET74299
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucacccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaacaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118217 - RNA, 1758 nt, Artificial Sequence; identical to SEQ ID NO: 118160
  derived and/or modified sequence opt2 from hemagglutinin__InfluenzaB__AET74329

SEQ ID NO: 118218 - RNA, 1758 nt, Artificial Sequence; identical to SEQ ID NO: 118160
  derived and/or modified sequence opt2 from hemagglutinin__InfluenzaB__AET74340

SEQ ID NO: 118219 - RNA, 1758 nt, Artificial Sequence; identical to SEQ ID NO: 118160
  derived and/or modified sequence opt2 from hemagglutinin__InfluenzaB__AET74351

SEQ ID NO: 118220 - RNA, 1758 nt, Artificial Sequence; identical to SEQ ID NO: 118157
  derived and/or modified sequence opt2 from hemagglutinin__InfluenzaB__AEY69077

SEQ ID NO: 118221 - RNA, 1758 nt, Artificial Sequence; identical to SEQ ID NO: 118157
  derived and/or modified sequence opt2 from hemagglutinin__InfluenzaB__AFB77676

SEQ ID NO: 118222 - RNA, 1758 nt, Artificial Sequence
  derived and/or modified sequence opt2 from hemagglutinin__InfluenzaB__AFB77677
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugcuucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118223 - RNA, 1758 nt, Artificial Sequence; identical to SEQ ID NO: 118157
  derived and/or modified sequence opt2 from hemagglutinin__InfluenzaB__AFB77678

SEQ ID NO: 118224 - RNA, 1758 nt, Artificial Sequence; identical to SEQ ID NO: 118157
  derived and/or modified sequence opt2 from hemagglutinin__InfluenzaB__AFB77679

SEQ ID NO: 118225 - RNA, 1758 nt, Artificial Sequence
  derived and/or modified sequence opt2 from hemagglutinin__InfluenzaB__AFB77680
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccaucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118226 - RNA, 1758 nt, Artificial Sequence; identical to SEQ ID NO: 118157
  derived and/or modified sequence opt2 from hemagglutinin__InfluenzaB__AFB77681

SEQ ID NO: 118227 - RNA, 1758 nt, Artificial Sequence
  derived and/or modified sequence opt2 from hemagglutinin__InfluenzaB__AFB77682
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucacccagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118228 - RNA, 1758 nt, Artificial Sequence; identical to SEQ ID NO: 118157
  derived and/or modified sequence opt2 from hemagglutinin__InfluenzaB__AFB77683

SEQ ID NO: 118229 - RNA, 1758 nt, Artificial Sequence; identical to SEQ ID NO: 118157
  derived and/or modified sequence opt2 from hemagglutinin__InfluenzaB__AFB77684

SEQ ID NO: 118230 - RNA, 1758 nt, Artificial Sequence
  derived and/or modified sequence opt2 from hemagglutinin__InfluenzaB__AFB77685
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagacccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacaucucccagaucggcggcuuccccaaccagaccgaggacggcggccucccccaguccggccgcaucgucgucgacuacaugguccagaaguccgagaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118231 - RNA, 1758 nt, Artificial Sequence
  derived and/or modified sequence opt2 from hemagglutinin__InfluenzaB__AFB77686
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucuccggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucacccagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118232 - RNA, 1758 nt, Artificial Sequence
  derived and/or modified sequence opt2 from hemagglutinin__InfluenzaB__AFB77687
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacaucaagcucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118233 - RNA, 1758 nt, Artificial Sequence
  derived and/or modified sequence opt2 from hemagglutinin__InfluenzaB__AFB77688
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaaggccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118234 - RNA, 1758 nt, Artificial Sequence; identical to SEQ ID NO: 118157
  derived and/or modified sequence opt2 from hemagglutinin__InfluenzaB__AFB77689

SEQ ID NO: 118235 - RNA, 1758 nt, Artificial Sequence; identical to SEQ ID NO: 118157
  derived and/or modified sequence opt2 from hemagglutinin__InfluenzaB__AFB77690

SEQ ID NO: 118236 - RNA, 1758 nt, Artificial Sequence; identical to SEQ ID NO: 118195
  derived and/or modified sequence opt2 from hemagglutinin__InfluenzaB__AFE00360

SEQ ID NO: 118237 - RNA, 1758 nt, Artificial Sequence; identical to SEQ ID NO: 118195
  derived and/or modified sequence opt2 from hemagglutinin__InfluenzaB__AFF18534

SEQ ID NO: 118238 - RNA, 1758 nt, Artificial Sequence; identical to SEQ ID NO: 118195
  derived and/or modified sequence opt2 from hemagglutinin__InfluenzaB__AFF18543

SEQ ID NO: 118239 - RNA, 1758 nt, Artificial Sequence; identical to SEQ ID NO: 118157
  derived and/or modified sequence opt2 from hemagglutinin__InfluenzaB__AFG48978

SEQ ID NO: 118240 - RNA, 1758 nt, Artificial Sequence; identical to SEQ ID NO: 118157
  derived and/or modified sequence opt2 from hemagglutinin__InfluenzaB__AFG48997

SEQ ID NO: 118241 - RNA, 1758 nt, Artificial Sequence
  derived and/or modified sequence opt2 from hemagglutinin__InfluenzaB__AFG48998
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgagaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118242 - RNA, 1755 nt, Artificial Sequence
  derived and/or modified sequence opt2 from hemagglutinin__InfluenzaB__AFG49012
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccuccuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118243 - RNA, 1755 nt, Artificial Sequence
  derived and/or modified sequence opt2 from hemagglutinin__InfluenzaB__AFG49013
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118244 - RNA, 1755 nt, Artificial Sequence
  derived and/or modified sequence opt2 from hemagglutinin__InfluenzaB__AFH57865
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccccaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118245 - RNA, 1755 nt, Artificial Sequence
  derived and/or modified sequence opt2 from hemagglutinin__InfluenzaB__AFH57876
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagaaccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118246 - RNA, 1755 nt, Artificial Sequence
  derived and/or modified sequence opt2 from hemagglutinin__InfluenzaB__AFH57942
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagaaccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118247 - RNA, 1752 nt, Artificial Sequence
  derived and/or modified sequence opt2 from hemagglutinin__InfluenzaB__AFH57986
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagcgcgcccccggcggccccuaccgccucggcaccuccggcuccugccccaacgucaccucccgcgacggcuucuucgccaccauggccugggccgucccccgcgacaacaagaccgccaccaacccccucaccgucgagguccccuacaucugcaccaagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118248 - RNA, 1758 nt, Artificial Sequence
  derived and/or modified sequence opt2 from hemagglutinin__InfluenzaB__AFH58249
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacaucccccccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgaggaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccacccuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118249 - RNA, 1758 nt, Artificial Sequence
  derived and/or modified sequence opt2 from hemagglutinin__InfluenzaB__AFH58260
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccuccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagcgcuacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118250 - RNA, 1755 nt, Artificial Sequence
  derived and/or modified sequence opt2 from hemagglutinin__InfluenzaB__AFH58271
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgaggucaagcccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118251 - RNA, 1755 nt, Artificial Sequence; identical to SEQ ID NO: 118250
  derived and/or modified sequence opt2 from hemagglutinin__InfluenzaB__AFH58282

SEQ ID NO: 118252 - RNA, 1758 nt, Artificial Sequence
  derived and/or modified sequence opt2 from hemagglutinin__InfluenzaB__AFH58293
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118253 - RNA, 1755 nt, Artificial Sequence
  derived and/or modified sequence opt2 from hemagglutinin__InfluenzaB__AFH58304
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118254 - RNA, 1755 nt, Artificial Sequence; identical to SEQ ID NO: 118253
  derived and/or modified sequence opt2 from hemagglutinin__InfluenzaB__AFH58315

SEQ ID NO: 118255 - RNA, 1755 nt, Artificial Sequence
  derived and/or modified sequence opt2 from hemagglutinin__InfluenzaB__AFH58326
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaaggcccagaugaagaaccucuacggcgacuccaacccccagaaguucaccuccuccgccaacggcgucaccacccacuacgucucccagaucggcgacuuccccgaccagaccgaggacggcggccccccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118256 - RNA, 1755 nt, Artificial Sequence
  derived and/or modified sequence opt2 from hemagglutinin__InfluenzaB__AFH58337
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaaggcccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118257 - RNA, 1758 nt, Artificial Sequence
  derived and/or modified sequence opt2 from hemagglutinin__InfluenzaB__AFH58348
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccgcccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaaggagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118258 - RNA, 1758 nt, Artificial Sequence
  derived and/or modified sequence opt2 from hemagglutinin__InfluenzaB__AFH58370
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccgcccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118259 - RNA, 1758 nt, Artificial Sequence
  derived and/or modified sequence opt2 from hemagglutinin__InfluenzaB__AFH58392
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118260 - RNA, 1758 nt, Artificial Sequence; identical to SEQ ID NO: 118252
  derived and/or modified sequence opt2 from hemagglutinin__InfluenzaB__AFH58403

SEQ ID NO: 118261 - RNA, 1758 nt, Artificial Sequence; identical to SEQ ID NO: 118252
  derived and/or modified sequence opt2 from hemagglutinin__InfluenzaB__AFH58414

SEQ ID NO: 118262 - RNA, 1758 nt, Artificial Sequence; identical to SEQ ID NO: 118252
  derived and/or modified sequence opt2 from hemagglutinin__InfluenzaB__AFH58425

SEQ ID NO: 118263 - RNA, 1758 nt, Artificial Sequence; identical to SEQ ID NO: 118252
  derived and/or modified sequence opt2 from hemagglutinin__InfluenzaB__AFH58436

SEQ ID NO: 118264 - RNA, 1758 nt, Artificial Sequence
  derived and/or modified sequence opt2 from hemagglutinin__InfluenzaB__AFH58458
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccaccaacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagauccagauggccaagcucuacggcgacucccgcccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118265 - RNA, 1758 nt, Artificial Sequence; identical to SEQ ID NO: 118264
  derived and/or modified sequence opt2 from hemagglutinin__InfluenzaB__AFH58469

SEQ ID NO: 118266 - RNA, 1755 nt, Artificial Sequence; identical to SEQ ID NO: 118246
  derived and/or modified sequence opt2 from hemagglutinin__InfluenzaB__AFH58480

SEQ ID NO: 118267 - RNA, 1755 nt, Artificial Sequence
  derived and/or modified sequence opt2 from hemagglutinin__InfluenzaB__AFH58502
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacgacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118268 - RNA, 1758 nt, Artificial Sequence
  derived and/or modified sequence opt2 from hemagglutinin__InfluenzaB__AFH58513
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118269 - RNA, 1758 nt, Artificial Sequence; identical to SEQ ID NO: 118268
  derived and/or modified sequence opt2 from hemagglutinin__InfluenzaB__AFH58524

SEQ ID NO: 118270 - RNA, 1755 nt, Artificial Sequence
  derived and/or modified sequence opt2 from hemagglutinin__InfluenzaB__AFH58535
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccagacccgcggcaagcucugccccaacugcuucaacugcaccgaccucgacgucgcccucggccgccccaagugcaugggcaacacccccuccgccaaggucuccauccuccacgaggucaagcccgccaccuccggcugcuuccccaucaugcacgaccgcaccaagauccgccagcuccccaaccuccuccgcggcuacgagaacauccgccucuccaccuccaacgucaucaacaccgagaccgcccccggcggccccuacaaggucggcaccuccggcuccugccccaacgucgccaacggcaacggcuucuucaacaccauggccugggucauccccaaggacaacaacaagaccgccaucaaccccgucaccgucgagguccccuacaucugcuccgagggcgaggaccagaucaccgucuggggcuuccacuccgacgacaagacccagauggagcgccucuacggcgacuccaacccccagaaguucaccuccuccgccaacggcgucaccacccacuacgucucccagaucggcggcuuccccaaccagaccgaggacgagggccucaagcaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacuaccucuccgagcucgaggucaagaaccuccagcgccucuccggcgccaugaacgagcuccacgacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118271 - RNA, 1752 nt, Artificial Sequence
  derived and/or modified sequence opt2 from hemagglutinin__InfluenzaB__AFH58557
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagcgcgcccccggcggccccuaccgccucggcaccuccggcuccugccccaacgucaccucccgcgacggcuucuucgccaccauggccugggccgucccccgcgacaacaagaccgccaccaacccccucaccgucgagguccccuacaucugcaccaagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucuccuuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118272 - RNA, 1755 nt, Artificial Sequence
  derived and/or modified sequence opt2 from hemagglutinin__InfluenzaB__AFJ76224
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggcucccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacaucgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118273 - RNA, 1755 nt, Artificial Sequence
  derived and/or modified sequence opt2 from hemagglutinin__InfluenzaB__AFJ76235
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggcucccccaugugcgucggcaucacccccuccgccaaggccuccauccuccacgagguccgccccgucaccucccgcugcuuccccaucaugcacgaccgcaccaagauccgccagcuccccaaccuccuccgcggcuacgagaagauccgccucuccacccagaacgucaucaacaucgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118274 - RNA, 1755 nt, Artificial Sequence; identical to SEQ ID NO: 118272
  derived and/or modified sequence opt2 from hemagglutinin__InfluenzaB__AFJ76246

SEQ ID NO: 118275 - RNA, 1758 nt, Artificial Sequence; identical to SEQ ID NO: 118026
  derived and/or modified sequence opt2 from hemagglutinin__InfluenzaB__AFJ76268

SEQ ID NO: 118276 - RNA, 1758 nt, Artificial Sequence; identical to SEQ ID NO: 118077
  derived and/or modified sequence opt2 from hemagglutinin__InfluenzaB__AFJ76301

SEQ ID NO: 118277 - RNA, 1755 nt, Artificial Sequence; identical to SEQ ID NO: 117938
  derived and/or modified sequence opt2 from hemagglutinin__InfluenzaB__AFJ76323

SEQ ID NO: 118278 - RNA, 1758 nt, Artificial Sequence
  derived and/or modified sequence opt2 from hemagglutinin__InfluenzaB__AFJ76334
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcuggaagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccgucuucgucgucuacauggucucccgcgacaacgucuccugcuccaucugccucuga

SEQ ID NO: 118279 - RNA, 1758 nt, Artificial Sequence; identical to SEQ ID NO: 118026
  derived and/or modified sequence opt2 from hemagglutinin__InfluenzaB__AFJ77327

SEQ ID NO: 118280 - RNA, 1755 nt, Artificial Sequence; identical to SEQ ID NO: 117938
  derived and/or modified sequence opt2 from hemagglutinin__InfluenzaB__AFJ77369

SEQ ID NO: 118281 - RNA, 1755 nt, Artificial Sequence; identical to SEQ ID NO: 117938
  derived and/or modified sequence opt2 from hemagglutinin__InfluenzaB__AFJ77380

SEQ ID NO: 118282 - RNA, 1755 nt, Artificial Sequence
  derived and/or modified sequence opt2 from hemagglutinin__InfluenzaB__AFJ80139
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcuuccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118283 - RNA, 1755 nt, Artificial Sequence
  derived and/or modified sequence opt2 from hemagglutinin__InfluenzaB__AFJ80150
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118284 - RNA, 1755 nt, Artificial Sequence
  derived and/or modified sequence opt2 from hemagglutinin__InfluenzaB__AFJ80161
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucuuccgcgacaacgucuccugcuccaucugccucuga

SEQ ID NO: 118285 - RNA, 1755 nt, Artificial Sequence
  derived and/or modified sequence opt2 from hemagglutinin__InfluenzaB__AFJ80172
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118286 - RNA, 1755 nt, Artificial Sequence; identical to SEQ ID NO: 118272
  derived and/or modified sequence opt2 from hemagglutinin__InfluenzaB__AFJ80183

SEQ ID NO: 118287 - RNA, 1755 nt, Artificial Sequence; identical to SEQ ID NO: 118283
  derived and/or modified sequence opt2 from hemagglutinin__InfluenzaB__AFJ80194

SEQ ID NO: 118288 - RNA, 1755 nt, Artificial Sequence; identical to SEQ ID NO: 118272
  derived and/or modified sequence opt2 from hemagglutinin__InfluenzaB__AFJ80205

SEQ ID NO: 118289 - RNA, 1755 nt, Artificial Sequence; identical to SEQ ID NO: 117917
  derived and/or modified sequence opt2 from hemagglutinin__InfluenzaB__AFJ80216

SEQ ID NO: 118290 - RNA, 1755 nt, Artificial Sequence; identical to SEQ ID NO: 118272
  derived and/or modified sequence opt2 from hemagglutinin__InfluenzaB__AFJ80227

SEQ ID NO: 118291 - RNA, 1758 nt, Artificial Sequence
  derived and/or modified sequence opt2 from hemagglutinin__InfluenzaB__AFJ80238
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccauccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118292 - RNA, 1755 nt, Artificial Sequence
  derived and/or modified sequence opt2 from hemagglutinin__InfluenzaB__AFJ80656
augaaggccaucaucguccuccucauggucgucaccuccaacgccgaccgcaucugcaccggcaucaccuccuccaacuccccccacgucguccgcaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 118293 - RNA, 1755 nt, Artificial Sequence; identical to SEQ ID NO: 118272
  derived and/or modified sequence opt2 from hemagglutinin__InfluenzaB__AFJ80667

SEQ ID NO: 118294 - RNA, 1755 nt, Artificial Sequence; identical to SEQ ID NO: 118272
  derived and/or modified sequence opt2 from hemagglutinin__InfluenzaB__AFJ80678

SEQ ID NO: 118295 - RNA, 1755 nt, Artificial Sequence; identical to SEQ ID NO: 118272
  derived and/or modified sequence opt2 from hemagglutinin__InfluenzaB__AFJ80689

SEQ ID NO: 118296 - RNA, 1755 nt, Artificial Sequence
  derived and/or modified sequence opt2 from hemagglutinin__InfluenzaB__AFJ80711
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaucaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118297 - RNA, 1755 nt, Artificial Sequence; identical to SEQ ID NO: 118296
  derived and/or modified sequence opt2 from hemagglutinin__InfluenzaB__AFJ80722

SEQ ID NO: 118298 - RNA, 1755 nt, Artificial Sequence
  derived and/or modified sequence opt2 from hemagglutinin__InfluenzaB__AFJ80733
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcaugggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccgacgccaccaacaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118299 - RNA, 1758 nt, Artificial Sequence; identical to SEQ ID NO: 118026
  derived and/or modified sequence opt2 from hemagglutinin__InfluenzaB__AFJ80744

SEQ ID NO: 118300 - RNA, 1758 nt, Artificial Sequence; identical to SEQ ID NO: 118026
  derived and/or modified sequence opt2 from hemagglutinin__InfluenzaB__AFJ80755

SEQ ID NO: 118301 - RNA, 1758 nt, Artificial Sequence; identical to SEQ ID NO: 118026
  derived and/or modified sequence opt2 from hemagglutinin__InfluenzaB__AFJ80781

SEQ ID NO: 118302 - RNA, 1758 nt, Artificial Sequence; identical to SEQ ID NO: 118026
  derived and/or modified sequence opt2 from hemagglutinin__InfluenzaB__AFJ80792

SEQ ID NO: 118303 - RNA, 1758 nt, Artificial Sequence; identical to SEQ ID NO: 118026
  derived and/or modified sequence opt2 from hemagglutinin__InfluenzaB__AFJ80803

SEQ ID NO: 118304 - RNA, 1758 nt, Artificial Sequence; identical to SEQ ID NO: 118026
  derived and/or modified sequence opt2 from hemagglutinin__InfluenzaB__AFJ80814

SEQ ID NO: 118305 - RNA, 1758 nt, Artificial Sequence
  derived and/or modified sequence opt2 from hemagglutinin__InfluenzaB__AFJ80825
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccaucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118306 - RNA, 1758 nt, Artificial Sequence; identical to SEQ ID NO: 118026
  derived and/or modified sequence opt2 from hemagglutinin__InfluenzaB__AFJ80836

SEQ ID NO: 118307 - RNA, 1758 nt, Artificial Sequence; identical to SEQ ID NO: 118094
  derived and/or modified sequence opt2 from hemagglutinin__InfluenzaB__AFJ80847

SEQ ID NO: 118308 - RNA, 1758 nt, Artificial Sequence; identical to SEQ ID NO: 118026
  derived and/or modified sequence opt2 from hemagglutinin__InfluenzaB__AFJ80858

SEQ ID NO: 118309 - RNA, 1758 nt, Artificial Sequence; identical to SEQ ID NO: 118026
  derived and/or modified sequence opt2 from hemagglutinin__InfluenzaB__AFJ80869

SEQ ID NO: 118310 - RNA, 1758 nt, Artificial Sequence; identical to SEQ ID NO: 118026
  derived and/or modified sequence opt2 from hemagglutinin__InfluenzaB__AFJ80880

SEQ ID NO: 118311 - RNA, 1758 nt, Artificial Sequence; identical to SEQ ID NO: 118077
  derived and/or modified sequence opt2 from hemagglutinin__InfluenzaB__AFJ80891

SEQ ID NO: 118312 - RNA, 1758 nt, Artificial Sequence; identical to SEQ ID NO: 118077
  derived and/or modified sequence opt2 from hemagglutinin__InfluenzaB__AFJ80902

SEQ ID NO: 118313 - RNA, 1758 nt, Artificial Sequence; identical to SEQ ID NO: 118026
  derived and/or modified sequence opt2 from hemagglutinin__InfluenzaB__AFJ80913

SEQ ID NO: 118314 - RNA, 1758 nt, Artificial Sequence
  derived and/or modified sequence opt2 from hemagglutinin__InfluenzaB__AFJ80924
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcgccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118315 - RNA, 1758 nt, Artificial Sequence; identical to SEQ ID NO: 118077
  derived and/or modified sequence opt2 from hemagglutinin__InfluenzaB__AFJ80935

SEQ ID NO: 118316 - RNA, 1755 nt, Artificial Sequence; identical to SEQ ID NO: 117938
  derived and/or modified sequence opt2 from hemagglutinin__InfluenzaB__AFJ80946

SEQ ID NO: 118317 - RNA, 1758 nt, Artificial Sequence
  derived and/or modified sequence opt2 from hemagglutinin__InfluenzaB__AFJ80957
augaaggccaucaucguccuccucauggucgccaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118318 - RNA, 1755 nt, Artificial Sequence; identical to SEQ ID NO: 117938
  derived and/or modified sequence opt2 from hemagglutinin__InfluenzaB__AFJ80968

SEQ ID NO: 118319 - RNA, 1755 nt, Artificial Sequence; identical to SEQ ID NO: 117938
  derived and/or modified sequence opt2 from hemagglutinin__InfluenzaB__AFJ80979

SEQ ID NO: 118320 - RNA, 1755 nt, Artificial Sequence
  derived and/or modified sequence opt2 from hemagglutinin__InfluenzaB__AFJ80990
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccgaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccaacaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118321 - RNA, 1755 nt, Artificial Sequence; identical to SEQ ID NO: 117938
  derived and/or modified sequence opt2 from hemagglutinin__InfluenzaB__AFJ81001

SEQ ID NO: 118322 - RNA, 1755 nt, Artificial Sequence; identical to SEQ ID NO: 117938
  derived and/or modified sequence opt2 from hemagglutinin__InfluenzaB__AFJ84360

SEQ ID NO: 118323 - RNA, 1758 nt, Artificial Sequence; identical to SEQ ID NO: 118026
  derived and/or modified sequence opt2 from hemagglutinin__InfluenzaB__AFJ90395

SEQ ID NO: 118324 - RNA, 1755 nt, Artificial Sequence; identical to SEQ ID NO: 117938
  derived and/or modified sequence opt2 from hemagglutinin__InfluenzaB__AFJ90406

SEQ ID NO: 118325 - RNA, 1755 nt, Artificial Sequence; identical to SEQ ID NO: 117938
  derived and/or modified sequence opt2 from hemagglutinin__InfluenzaB__AFJ90417

SEQ ID NO: 118326 - RNA, 1755 nt, Artificial Sequence; identical to SEQ ID NO: 117938
  derived and/or modified sequence opt2 from hemagglutinin__InfluenzaB__AFJ90428

SEQ ID NO: 118327 - RNA, 1755 nt, Artificial Sequence; identical to SEQ ID NO: 117938
  derived and/or modified sequence opt2 from hemagglutinin__InfluenzaB__AFJ90450

SEQ ID NO: 118328 - RNA, 1755 nt, Artificial Sequence; identical to SEQ ID NO: 117938
  derived and/or modified sequence opt2 from hemagglutinin__InfluenzaB__AFJ91038

SEQ ID NO: 118329 - RNA, 1755 nt, Artificial Sequence
  derived and/or modified sequence opt2 from hemagglutinin__InfluenzaB__AFJ91049
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaucacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118330 - RNA, 1758 nt, Artificial Sequence
  derived and/or modified sequence opt2 from hemagglutinin__InfluenzaB__AFJ91060
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugcccccgcugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118331 - RNA, 1755 nt, Artificial Sequence; identical to SEQ ID NO: 117938
  derived and/or modified sequence opt2 from hemagglutinin__InfluenzaB__AFJ91071

SEQ ID NO: 118332 - RNA, 1755 nt, Artificial Sequence
  derived and/or modified sequence opt2 from hemagglutinin__InfluenzaB__AFJ91082
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118333 - RNA, 1755 nt, Artificial Sequence; identical to SEQ ID NO: 118332
  derived and/or modified sequence opt2 from hemagglutinin__InfluenzaB__AFJ91093

SEQ ID NO: 118334 - RNA, 1755 nt, Artificial Sequence; identical to SEQ ID NO: 118332
  derived and/or modified sequence opt2 from hemagglutinin__InfluenzaB__AFJ91104

SEQ ID NO: 118335 - RNA, 1755 nt, Artificial Sequence; identical to SEQ ID NO: 118332
  derived and/or modified sequence opt2 from hemagglutinin__InfluenzaB__AFJ91115

SEQ ID NO: 118336 - RNA, 1758 nt, Artificial Sequence
  derived and/or modified sequence opt2 from hemagglutinin__InfluenzaB__AFJ91704
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaagggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118337 - RNA, 1755 nt, Artificial Sequence
  derived and/or modified sequence opt2 from hemagglutinin__InfluenzaB__AFK09797
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaucaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagaaccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118338 - RNA, 1755 nt, Artificial Sequence; identical to SEQ ID NO: 118332
  derived and/or modified sequence opt2 from hemagglutinin__InfluenzaB__AFN54654

SEQ ID NO: 118339 - RNA, 1755 nt, Artificial Sequence; identical to SEQ ID NO: 118079
  derived and/or modified sequence opt2 from hemagglutinin__InfluenzaB__AFN54665

SEQ ID NO: 118340 - RNA, 1755 nt, Artificial Sequence; identical to SEQ ID NO: 118079
  derived and/or modified sequence opt2 from hemagglutinin__InfluenzaB__AFN54676

SEQ ID NO: 118341 - RNA, 1755 nt, Artificial Sequence; identical to SEQ ID NO: 118332
  derived and/or modified sequence opt2 from hemagglutinin__InfluenzaB__AFN54687

SEQ ID NO: 118342 - RNA, 1755 nt, Artificial Sequence
  derived and/or modified sequence opt2 from hemagglutinin__InfluenzaB__AFN54698
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuucgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118343 - RNA, 1755 nt, Artificial Sequence; identical to SEQ ID NO: 118332
  derived and/or modified sequence opt2 from hemagglutinin__InfluenzaB__AFN54709

SEQ ID NO: 118344 - RNA, 1755 nt, Artificial Sequence; identical to SEQ ID NO: 118332
  derived and/or modified sequence opt2 from hemagglutinin__InfluenzaB__AFN54720

SEQ ID NO: 118345 - RNA, 1755 nt, Artificial Sequence; identical to SEQ ID NO: 118332
  derived and/or modified sequence opt2 from hemagglutinin__InfluenzaB__AFN54731

SEQ ID NO: 118346 - RNA, 1755 nt, Artificial Sequence; identical to SEQ ID NO: 118332
  derived and/or modified sequence opt2 from hemagglutinin__InfluenzaB__AFN54742

SEQ ID NO: 118347 - RNA, 1755 nt, Artificial Sequence; identical to SEQ ID NO: 118332
  derived and/or modified sequence opt2 from hemagglutinin__InfluenzaB__AFN54753

SEQ ID NO: 118348 - RNA, 1755 nt, Artificial Sequence; identical to SEQ ID NO: 118332
  derived and/or modified sequence opt2 from hemagglutinin__InfluenzaB__AFN54764

SEQ ID NO: 118349 - RNA, 1755 nt, Artificial Sequence; identical to SEQ ID NO: 118332
  derived and/or modified sequence opt2 from hemagglutinin__InfluenzaB__AFN54775

SEQ ID NO: 118350 - RNA, 1755 nt, Artificial Sequence; identical to SEQ ID NO: 118332
  derived and/or modified sequence opt2 from hemagglutinin__InfluenzaB__AFN54786

SEQ ID NO: 118351 - RNA, 1755 nt, Artificial Sequence; identical to SEQ ID NO: 118332
  derived and/or modified sequence opt2 from hemagglutinin__InfluenzaB__AFN54797

SEQ ID NO: 118352 - RNA, 1755 nt, Artificial Sequence; identical to SEQ ID NO: 118332
  derived and/or modified sequence opt2 from hemagglutinin__InfluenzaB__AFN54808

SEQ ID NO: 118353 - RNA, 1755 nt, Artificial Sequence; identical to SEQ ID NO: 118079
  derived and/or modified sequence opt2 from hemagglutinin__InfluenzaB__AFN54819

SEQ ID NO: 118354 - RNA, 1755 nt, Artificial Sequence; identical to SEQ ID NO: 118332
  derived and/or modified sequence opt2 from hemagglutinin__InfluenzaB__AFN54830

SEQ ID NO: 118355 - RNA, 1755 nt, Artificial Sequence; identical to SEQ ID NO: 118332
  derived and/or modified sequence opt2 from hemagglutinin__InfluenzaB__AFN54841

SEQ ID NO: 118356 - RNA, 1755 nt, Artificial Sequence; identical to SEQ ID NO: 118332
  derived and/or modified sequence opt2 from hemagglutinin__InfluenzaB__AFN54852

SEQ ID NO: 118357 - RNA, 1755 nt, Artificial Sequence; identical to SEQ ID NO: 118332
  derived and/or modified sequence opt2 from hemagglutinin__InfluenzaB__AFN54863

SEQ ID NO: 118358 - RNA, 1758 nt, Artificial Sequence
  derived and/or modified sequence opt2 from hemagglutinin__InfluenzaB__AFU34595
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuaccgcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccaccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118359 - RNA, 1758 nt, Artificial Sequence
  derived and/or modified sequence opt2 from hemagglutinin__InfluenzaB__AFU34606
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucgaccgccccaagugcaccggcaagauccccuccgcccgcgucuccauccuccacgagguccgccucgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118360 - RNA, 1758 nt, Artificial Sequence; identical to SEQ ID NO: 118268
  derived and/or modified sequence opt2 from hemagglutinin__InfluenzaB__AFU34617

SEQ ID NO: 118361 - RNA, 1758 nt, Artificial Sequence
  derived and/or modified sequence opt2 from hemagglutinin__InfluenzaB__AFU34628
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuuccucggcgccaucgccggcuuccucgagggcggcuggaagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118362 - RNA, 1758 nt, Artificial Sequence; identical to SEQ ID NO: 118120
  derived and/or modified sequence opt2 from hemagglutinin__InfluenzaB__AFU34639

SEQ ID NO: 118363 - RNA, 1758 nt, Artificial Sequence; identical to SEQ ID NO: 118157
  derived and/or modified sequence opt2 from hemagglutinin__InfluenzaB__AGB08299

SEQ ID NO: 118364 - RNA, 1758 nt, Artificial Sequence; identical to SEQ ID NO: 118157
  derived and/or modified sequence opt2 from hemagglutinin__InfluenzaB__AGB08300

SEQ ID NO: 118365 - RNA, 1755 nt, Artificial Sequence
  derived and/or modified sequence opt2 from hemagglutinin__InfluenzaB__AGB97259
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacaucgucucccgcgacaacgucuccugcuccaucugccucuga

SEQ ID NO: 118366 - RNA, 1755 nt, Artificial Sequence
  derived and/or modified sequence opt2 from hemagglutinin__InfluenzaB__AGB97265
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118367 - RNA, 1755 nt, Artificial Sequence; identical to SEQ ID NO: 118366
  derived and/or modified sequence opt2 from hemagglutinin__InfluenzaB__AGF44878

SEQ ID NO: 118368 - RNA, 1755 nt, Artificial Sequence; identical to SEQ ID NO: 118366
  derived and/or modified sequence opt2 from hemagglutinin__InfluenzaB__AGF44879

SEQ ID NO: 118369 - RNA, 1755 nt, Artificial Sequence
  derived and/or modified sequence opt2 from hemagglutinin__InfluenzaB__AGF44881
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucauccucaugcucgccaucuucaucgucuacauggucucccgcgacaacgucuccugcuccaucugccucuga

SEQ ID NO: 118370 - RNA, 1755 nt, Artificial Sequence
  derived and/or modified sequence opt2 from hemagglutinin__InfluenzaB__AGF44882
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggcaaguccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118371 - RNA, 1755 nt, Artificial Sequence; identical to SEQ ID NO: 118366
  derived and/or modified sequence opt2 from hemagglutinin__InfluenzaB__AGF44883

SEQ ID NO: 118372 - RNA, 1755 nt, Artificial Sequence; identical to SEQ ID NO: 118366
  derived and/or modified sequence opt2 from hemagglutinin__InfluenzaB__AGF44884

SEQ ID NO: 118373 - RNA, 1755 nt, Artificial Sequence; identical to SEQ ID NO: 118366
  derived and/or modified sequence opt2 from hemagglutinin__InfluenzaB__AGF44886

SEQ ID NO: 118374 - RNA, 1755 nt, Artificial Sequence; identical to SEQ ID NO: 118366
  derived and/or modified sequence opt2 from hemagglutinin__InfluenzaB__AGF44887

SEQ ID NO: 118375 - RNA, 1755 nt, Artificial Sequence; identical to SEQ ID NO: 118366
  derived and/or modified sequence opt2 from hemagglutinin__InfluenzaB__AGF44888

SEQ ID NO: 118376 - RNA, 1755 nt, Artificial Sequence
  derived and/or modified sequence opt2 from hemagglutinin__InfluenzaB__AGL09834
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118377 - RNA, 1755 nt, Artificial Sequence; identical to SEQ ID NO: 118366
  derived and/or modified sequence opt2 from hemagglutinin__InfluenzaB__AGL09835

SEQ ID NO: 118378 - RNA, 1755 nt, Artificial Sequence
  derived and/or modified sequence opt2 from hemagglutinin__InfluenzaB__AGL09836
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccaagaaggcccccggcggccccuaccgccucggcaccuccggcuccugccccaacgccaccuccaaguccggcuucuucgccaccauggccugggccguccccgaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118379 - RNA, 1755 nt, Artificial Sequence; identical to SEQ ID NO: 118366
  derived and/or modified sequence opt2 from hemagglutinin__InfluenzaB__AGL09837

SEQ ID NO: 118380 - RNA, 1755 nt, Artificial Sequence; identical to SEQ ID NO: 118366
  derived and/or modified sequence opt2 from hemagglutinin__InfluenzaB__AGL09838

SEQ ID NO: 118381 - RNA, 1755 nt, Artificial Sequence; identical to SEQ ID NO: 118366
  derived and/or modified sequence opt2 from hemagglutinin__InfluenzaB__AGL09839

SEQ ID NO: 118382 - RNA, 1755 nt, Artificial Sequence; identical to SEQ ID NO: 118366
  derived and/or modified sequence opt2 from hemagglutinin__InfluenzaB__AGL09840

SEQ ID NO: 118383 - RNA, 1755 nt, Artificial Sequence; identical to SEQ ID NO: 118366
  derived and/or modified sequence opt2 from hemagglutinin__InfluenzaB__AGL09841

SEQ ID NO: 118384 - RNA, 1758 nt, Artificial Sequence
  derived and/or modified sequence opt2 from hemagglutinin__InfluenzaB__AGL09842
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgagaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118385 - RNA, 1755 nt, Artificial Sequence; identical to SEQ ID NO: 118366
  derived and/or modified sequence opt2 from hemagglutinin__InfluenzaB__AGL09843

SEQ ID NO: 118386 - RNA, 1755 nt, Artificial Sequence
  derived and/or modified sequence opt2 from hemagglutinin__InfluenzaB__AGL09844
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaaggaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118387 - RNA, 1755 nt, Artificial Sequence; identical to SEQ ID NO: 118366
  derived and/or modified sequence opt2 from hemagglutinin__InfluenzaB__AGL09845

SEQ ID NO: 118388 - RNA, 1755 nt, Artificial Sequence; identical to SEQ ID NO: 118366
  derived and/or modified sequence opt2 from hemagglutinin__InfluenzaB__AGL09846

SEQ ID NO: 118389 - RNA, 1755 nt, Artificial Sequence
  derived and/or modified sequence opt2 from hemagglutinin__InfluenzaB__AGL09847
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccaucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118390 - RNA, 1755 nt, Artificial Sequence
  derived and/or modified sequence opt2 from hemagglutinin__InfluenzaB__AGL09849
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucaacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118391 - RNA, 1755 nt, Artificial Sequence; identical to SEQ ID NO: 118366
  derived and/or modified sequence opt2 from hemagglutinin__InfluenzaB__AGL09850

SEQ ID NO: 118392 - RNA, 1755 nt, Artificial Sequence; identical to SEQ ID NO: 118366
  derived and/or modified sequence opt2 from hemagglutinin__InfluenzaB__AGL09851

SEQ ID NO: 118393 - RNA, 1758 nt, Artificial Sequence; identical to SEQ ID NO: 118157
  derived and/or modified sequence opt2 from hemagglutinin__InfluenzaB__AGL09852

SEQ ID NO: 118394 - RNA, 1755 nt, Artificial Sequence; identical to SEQ ID NO: 118366
  derived and/or modified sequence opt2 from hemagglutinin__InfluenzaB__AGL09853

SEQ ID NO: 118395 - RNA, 1755 nt, Artificial Sequence; identical to SEQ ID NO: 118366
  derived and/or modified sequence opt2 from hemagglutinin__InfluenzaB__AGL09854

SEQ ID NO: 118396 - RNA, 1758 nt, Artificial Sequence
  derived and/or modified sequence opt2 from hemagglutinin__InfluenzaB__AGL09855
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgagaccaacccccucaccaucgagguccccuacaucugcaccgaggaggaggaccagaucaccgucuggggcuuccacuccgacaacgagacccagauggccaagcucuacggcgacuccaagccccagaaguucaccuccuccgccaacggcgucaccacccacuacgucucccagaucggcgacuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118397 - RNA, 1755 nt, Artificial Sequence; identical to SEQ ID NO: 118366
  derived and/or modified sequence opt2 from hemagglutinin__InfluenzaB__AGL09856

SEQ ID NO: 118398 - RNA, 1755 nt, Artificial Sequence
  derived and/or modified sequence opt2 from hemagglutinin__InfluenzaB__AGL09857
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaaggucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118399 - RNA, 1758 nt, Artificial Sequence
  derived and/or modified sequence opt2 from hemagglutinin__InfluenzaB__AGL09859
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118400 - RNA, 1758 nt, Artificial Sequence; identical to SEQ ID NO: 118399
  derived and/or modified sequence opt2 from hemagglutinin__InfluenzaB__AGL09860

SEQ ID NO: 118401 - RNA, 1758 nt, Artificial Sequence; identical to SEQ ID NO: 118399
  derived and/or modified sequence opt2 from hemagglutinin__InfluenzaB__AGL09861

SEQ ID NO: 118402 - RNA, 1758 nt, Artificial Sequence; identical to SEQ ID NO: 118399
  derived and/or modified sequence opt2 from hemagglutinin__InfluenzaB__AGL09862

SEQ ID NO: 118403 - RNA, 1758 nt, Artificial Sequence; identical to SEQ ID NO: 118399
  derived and/or modified sequence opt2 from hemagglutinin__InfluenzaB__AGL09863

SEQ ID NO: 118404 - RNA, 1755 nt, Artificial Sequence; identical to SEQ ID NO: 118366
  derived and/or modified sequence opt2 from hemagglutinin__InfluenzaB__AGL09864

SEQ ID NO: 118405 - RNA, 1755 nt, Artificial Sequence; identical to SEQ ID NO: 118366
  derived and/or modified sequence opt2 from hemagglutinin__InfluenzaB__AGL09866

SEQ ID NO: 118406 - RNA, 1755 nt, Artificial Sequence; identical to SEQ ID NO: 118366
  derived and/or modified sequence opt2 from hemagglutinin__InfluenzaB__AGL09867

SEQ ID NO: 118407 - RNA, 1755 nt, Artificial Sequence; identical to SEQ ID NO: 118366
  derived and/or modified sequence opt2 from hemagglutinin__InfluenzaB__AGL09868

SEQ ID NO: 118408 - RNA, 1755 nt, Artificial Sequence
  derived and/or modified sequence opt2 from hemagglutinin__InfluenzaB__AGL09869
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacaccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118409 - RNA, 1755 nt, Artificial Sequence
  derived and/or modified sequence opt2 from hemagglutinin__InfluenzaB__AGL09870
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagcgcuucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118410 - RNA, 1755 nt, Artificial Sequence; identical to SEQ ID NO: 118366
  derived and/or modified sequence opt2 from hemagglutinin__InfluenzaB__AGL09871

SEQ ID NO: 118411 - RNA, 1755 nt, Artificial Sequence
  derived and/or modified sequence opt2 from hemagglutinin__InfluenzaB__AGL09872
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118412 - RNA, 1755 nt, Artificial Sequence; identical to SEQ ID NO: 118366
  derived and/or modified sequence opt2 from hemagglutinin__InfluenzaB__AGL09873

SEQ ID NO: 118413 - RNA, 1758 nt, Artificial Sequence; identical to SEQ ID NO: 118399
  derived and/or modified sequence opt2 from hemagglutinin__InfluenzaB__AGL09874

SEQ ID NO: 118414 - RNA, 1758 nt, Artificial Sequence; identical to SEQ ID NO: 118384
  derived and/or modified sequence opt2 from hemagglutinin__InfluenzaB__AGO02695

SEQ ID NO: 118415 - RNA, 1755 nt, Artificial Sequence; identical to SEQ ID NO: 118366
  derived and/or modified sequence opt2 from hemagglutinin__InfluenzaB__AGQ16249

SEQ ID NO: 118416 - RNA, 1758 nt, Artificial Sequence; identical to SEQ ID NO: 118399
  derived and/or modified sequence opt2 from hemagglutinin__InfluenzaB__AGQ16250

SEQ ID NO: 118417 - RNA, 1758 nt, Artificial Sequence; identical to SEQ ID NO: 118399
  derived and/or modified sequence opt2 from hemagglutinin__InfluenzaB__AGQ16251

SEQ ID NO: 118418 - RNA, 1755 nt, Artificial Sequence
  derived and/or modified sequence opt2 from hemagglutinin__InfluenzaB__AGQ16252
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccgccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118419 - RNA, 1755 nt, Artificial Sequence; identical to SEQ ID NO: 118366
  derived and/or modified sequence opt2 from hemagglutinin__InfluenzaB__AGQ16253

SEQ ID NO: 118420 - RNA, 1755 nt, Artificial Sequence
  derived and/or modified sequence opt2 from hemagglutinin__InfluenzaB__AGQ16255
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaucauccuccucuacuacuccaccgccgccuccucccucgccgucacccucaugcucgccaucuucaucgucuacauggucucccgcgacaacgucuccugcuccaucugccucuga

SEQ ID NO: 118421 - RNA, 1755 nt, Artificial Sequence
  derived and/or modified sequence opt2 from hemagglutinin__InfluenzaB__AGQ16256
augaaggccaucaucguccuccucauggucgucaccuccaacgccgaccgcaucugcaccggcaucaccuccuccaacuccccccacgucgucaagaccgucacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacuccaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118422 - RNA, 1755 nt, Artificial Sequence; identical to SEQ ID NO: 118366
  derived and/or modified sequence opt2 from hemagglutinin__InfluenzaB__AGQ16257

SEQ ID NO: 118423 - RNA, 1755 nt, Artificial Sequence; identical to SEQ ID NO: 118366
  derived and/or modified sequence opt2 from hemagglutinin__InfluenzaB__AGQ16258

SEQ ID NO: 118424 - RNA, 1755 nt, Artificial Sequence; identical to SEQ ID NO: 118366
  derived and/or modified sequence opt2 from hemagglutinin__InfluenzaB__AGQ16259

SEQ ID NO: 118425 - RNA, 1755 nt, Artificial Sequence
  derived and/or modified sequence opt2 from hemagglutinin__InfluenzaB__AGQ16260
augaagaccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccucccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118426 - RNA, 1755 nt, Artificial Sequence; identical to SEQ ID NO: 118366
  derived and/or modified sequence opt2 from hemagglutinin__InfluenzaB__AGQ16261

SEQ ID NO: 118427 - RNA, 1755 nt, Artificial Sequence; identical to SEQ ID NO: 118366
  derived and/or modified sequence opt2 from hemagglutinin__InfluenzaB__AGQ16262

SEQ ID NO: 118428 - RNA, 1758 nt, Artificial Sequence; identical to SEQ ID NO: 118399
  derived and/or modified sequence opt2 from hemagglutinin__InfluenzaB__AGQ16263

SEQ ID NO: 118429 - RNA, 1758 nt, Artificial Sequence; identical to SEQ ID NO: 118399
  derived and/or modified sequence opt2 from hemagglutinin__InfluenzaB__AGQ16264

SEQ ID NO: 118430 - RNA, 1755 nt, Artificial Sequence; identical to SEQ ID NO: 118411
  derived and/or modified sequence opt2 from hemagglutinin__InfluenzaB__AGQ16265

SEQ ID NO: 118431 - RNA, 1755 nt, Artificial Sequence
  derived and/or modified sequence opt2 from hemagglutinin__InfluenzaB__AGQ16266
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccaggucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118432 - RNA, 1755 nt, Artificial Sequence; identical to SEQ ID NO: 118411
  derived and/or modified sequence opt2 from hemagglutinin__InfluenzaB__AGQ16267

SEQ ID NO: 118433 - RNA, 1755 nt, Artificial Sequence; identical to SEQ ID NO: 118411
  derived and/or modified sequence opt2 from hemagglutinin__InfluenzaB__AGQ16268

SEQ ID NO: 118434 - RNA, 1758 nt, Artificial Sequence; identical to SEQ ID NO: 118384
  derived and/or modified sequence opt2 from hemagglutinin__InfluenzaB__AGQ16269

SEQ ID NO: 118435 - RNA, 1755 nt, Artificial Sequence; identical to SEQ ID NO: 118411
  derived and/or modified sequence opt2 from hemagglutinin__InfluenzaB__AGQ16270

SEQ ID NO: 118436 - RNA, 1755 nt, Artificial Sequence
  derived and/or modified sequence opt2 from hemagglutinin__InfluenzaB__AGQ16272
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccgucccccgcgacaacaacaagaacgccaccaacccccucaccgucgagguccccuacaucugcgaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118437 - RNA, 1755 nt, Artificial Sequence; identical to SEQ ID NO: 118366
  derived and/or modified sequence opt2 from hemagglutinin__InfluenzaB__AGQ16273

SEQ ID NO: 118438 - RNA, 1755 nt, Artificial Sequence; identical to SEQ ID NO: 118366
  derived and/or modified sequence opt2 from hemagglutinin__InfluenzaB__AGQ16274

SEQ ID NO: 118439 - RNA, 1755 nt, Artificial Sequence; identical to SEQ ID NO: 118366
  derived and/or modified sequence opt2 from hemagglutinin__InfluenzaB__AGQ16275

SEQ ID NO: 118440 - RNA, 1755 nt, Artificial Sequence; identical to SEQ ID NO: 118366
  derived and/or modified sequence opt2 from hemagglutinin__InfluenzaB__AGQ16276

SEQ ID NO: 118441 - RNA, 1755 nt, Artificial Sequence; identical to SEQ ID NO: 118411
  derived and/or modified sequence opt2 from hemagglutinin__InfluenzaB__AGQ16277

SEQ ID NO: 118442 - RNA, 1755 nt, Artificial Sequence; identical to SEQ ID NO: 118411
  derived and/or modified sequence opt2 from hemagglutinin__InfluenzaB__AGQ16278

SEQ ID NO: 118443 - RNA, 1755 nt, Artificial Sequence; identical to SEQ ID NO: 118411
  derived and/or modified sequence opt2 from hemagglutinin__InfluenzaB__AGQ16279

SEQ ID NO: 118444 - RNA, 1755 nt, Artificial Sequence; identical to SEQ ID NO: 118411
  derived and/or modified sequence opt2 from hemagglutinin__InfluenzaB__AGQ16280

SEQ ID NO: 118445 - RNA, 1755 nt, Artificial Sequence
  derived and/or modified sequence opt2 from hemagglutinin__InfluenzaB__AGQ16281
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118446 - RNA, 1755 nt, Artificial Sequence
  derived and/or modified sequence opt2 from hemagglutinin__InfluenzaB__AGQ16282
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaagggcaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagcgcuucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118447 - RNA, 1755 nt, Artificial Sequence
  derived and/or modified sequence opt2 from hemagglutinin__InfluenzaB__AGQ16283
augaaggccaucaucguccuccucauggucgucaccuccaacgccgaccgcaucugcaccggcaucaccuccuccaacuccccccacgucgucaagaccgccacccacggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118448 - RNA, 1758 nt, Artificial Sequence
  derived and/or modified sequence opt2 from hemagglutinin__InfluenzaB__AGQ16284
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgaggcccgccccgucaccuccggcugcuuccccaucaugcacgaccgcaccaagauccgccagcuccccaaccuccuccgcggcuacgagcacaucaagcucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118449 - RNA, 1755 nt, Artificial Sequence; identical to SEQ ID NO: 118411
  derived and/or modified sequence opt2 from hemagglutinin__InfluenzaB__AGQ16285

SEQ ID NO: 118450 - RNA, 1755 nt, Artificial Sequence; identical to SEQ ID NO: 118411
  derived and/or modified sequence opt2 from hemagglutinin__InfluenzaB__AGQ16286

SEQ ID NO: 118451 - RNA, 1755 nt, Artificial Sequence
  derived and/or modified sequence opt2 from hemagglutinin__InfluenzaB__AGQ16287
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118452 - RNA, 1755 nt, Artificial Sequence; identical to SEQ ID NO: 118366
  derived and/or modified sequence opt2 from hemagglutinin__InfluenzaB__AGQ16289

SEQ ID NO: 118453 - RNA, 1755 nt, Artificial Sequence; identical to SEQ ID NO: 118366
  derived and/or modified sequence opt2 from hemagglutinin__InfluenzaB__AGQ16290

SEQ ID NO: 118454 - RNA, 1755 nt, Artificial Sequence
  derived and/or modified sequence opt2 from hemagglutinin__InfluenzaB__AGQ16291
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacaccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118455 - RNA, 1755 nt, Artificial Sequence
  derived and/or modified sequence opt2 from hemagglutinin__InfluenzaB__AGQ16292
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgagaucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118456 - RNA, 1755 nt, Artificial Sequence; identical to SEQ ID NO: 118455
  derived and/or modified sequence opt2 from hemagglutinin__InfluenzaB__AGQ16293

SEQ ID NO: 118457 - RNA, 1755 nt, Artificial Sequence; identical to SEQ ID NO: 118455
  derived and/or modified sequence opt2 from hemagglutinin__InfluenzaB__AGQ16294

SEQ ID NO: 118458 - RNA, 1758 nt, Artificial Sequence
  derived and/or modified sequence opt2 from hemagglutinin__InfluenzaB__AGQ16295
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgagaccaacccccucaccaucgagguccccuacaucugcaccgaggaggaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118459 - RNA, 1758 nt, Artificial Sequence; identical to SEQ ID NO: 118399
  derived and/or modified sequence opt2 from hemagglutinin__InfluenzaB__AGQ16296

SEQ ID NO: 118460 - RNA, 1755 nt, Artificial Sequence; identical to SEQ ID NO: 118366
  derived and/or modified sequence opt2 from hemagglutinin__InfluenzaB__AGQ16297

SEQ ID NO: 118461 - RNA, 1755 nt, Artificial Sequence
  derived and/or modified sequence opt2 from hemagglutinin__InfluenzaB__AGQ16298
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccaucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118462 - RNA, 1755 nt, Artificial Sequence; identical to SEQ ID NO: 118411
  derived and/or modified sequence opt2 from hemagglutinin__InfluenzaB__AGQ16299

SEQ ID NO: 118463 - RNA, 1755 nt, Artificial Sequence; identical to SEQ ID NO: 118411
  derived and/or modified sequence opt2 from hemagglutinin__InfluenzaB__AGQ16300

SEQ ID NO: 118464 - RNA, 1755 nt, Artificial Sequence; identical to SEQ ID NO: 118366
  derived and/or modified sequence opt2 from hemagglutinin__InfluenzaB__AGQ16301

SEQ ID NO: 118465 - RNA, 1755 nt, Artificial Sequence; identical to SEQ ID NO: 118366
  derived and/or modified sequence opt2 from hemagglutinin__InfluenzaB__AGQ16302

SEQ ID NO: 118466 - RNA, 1755 nt, Artificial Sequence; identical to SEQ ID NO: 118366
  derived and/or modified sequence opt2 from hemagglutinin__InfluenzaB__AGQ16303

SEQ ID NO: 118467 - RNA, 1755 nt, Artificial Sequence; identical to SEQ ID NO: 118366
  derived and/or modified sequence opt2 from hemagglutinin__InfluenzaB__AGQ16305

SEQ ID NO: 118468 - RNA, 1758 nt, Artificial Sequence
  derived and/or modified sequence opt2 from hemagglutinin__InfluenzaB__AGQ16306
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgagaccaacccccucaccaucgagguccccuacaucugcaaggagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118469 - RNA, 1755 nt, Artificial Sequence; identical to SEQ ID NO: 118366
  derived and/or modified sequence opt2 from hemagglutinin__InfluenzaB__AGQ16307

SEQ ID NO: 118470 - RNA, 1758 nt, Artificial Sequence; identical to SEQ ID NO: 118399
  derived and/or modified sequence opt2 from hemagglutinin__InfluenzaB__AGQ16308

SEQ ID NO: 118471 - RNA, 1755 nt, Artificial Sequence
  derived and/or modified sequence opt2 from hemagglutinin__InfluenzaB__AGQ16309
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgccgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118472 - RNA, 1755 nt, Artificial Sequence
  derived and/or modified sequence opt2 from hemagglutinin__InfluenzaB__AGQ16310
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcauggucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118473 - RNA, 1758 nt, Artificial Sequence; identical to SEQ ID NO: 118399
  derived and/or modified sequence opt2 from hemagglutinin__InfluenzaB__AGQ16311

SEQ ID NO: 118474 - RNA, 1755 nt, Artificial Sequence; identical to SEQ ID NO: 118366
  derived and/or modified sequence opt2 from hemagglutinin__InfluenzaB__AGQ16312

SEQ ID NO: 118475 - RNA, 1755 nt, Artificial Sequence
  derived and/or modified sequence opt2 from hemagglutinin__InfluenzaB__AGQ16313
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagaagggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118476 - RNA, 1758 nt, Artificial Sequence
  derived and/or modified sequence opt2 from hemagglutinin__InfluenzaB__AGQ16314
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgagaccaacccccucaccaucgagguccccuacaucugcaccgaggaggaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118477 - RNA, 1755 nt, Artificial Sequence
  derived and/or modified sequence opt2 from hemagglutinin__InfluenzaB__AGQ16315
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaccgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaucauccuccucuacuacuccaccgccgccuccucccucgccgucacccucaugcucgccaucuucaucgucuacauggucucccgcgacaacgucuccugcuccaucugccucuga

SEQ ID NO: 118478 - RNA, 1755 nt, Artificial Sequence; identical to SEQ ID NO: 118366
  derived and/or modified sequence opt2 from hemagglutinin__InfluenzaB__AGQ16316

SEQ ID NO: 118479 - RNA, 1755 nt, Artificial Sequence; identical to SEQ ID NO: 118366
  derived and/or modified sequence opt2 from hemagglutinin__InfluenzaB__AGQ16317

SEQ ID NO: 118480 - RNA, 1758 nt, Artificial Sequence; identical to SEQ ID NO: 118157
  derived and/or modified sequence opt2 from hemagglutinin__InfluenzaB__AGQ16318

SEQ ID NO: 118481 - RNA, 1755 nt, Artificial Sequence
  derived and/or modified sequence opt2 from hemagglutinin__InfluenzaB__AGQ16319
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccggcugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118482 - RNA, 1755 nt, Artificial Sequence; identical to SEQ ID NO: 118411
  derived and/or modified sequence opt2 from hemagglutinin__InfluenzaB__AGQ16320

SEQ ID NO: 118483 - RNA, 1755 nt, Artificial Sequence; identical to SEQ ID NO: 118366
  derived and/or modified sequence opt2 from hemagglutinin__InfluenzaB__AGQ16321

SEQ ID NO: 118484 - RNA, 1755 nt, Artificial Sequence; identical to SEQ ID NO: 118366
  derived and/or modified sequence opt2 from hemagglutinin__InfluenzaB__AGQ16322

SEQ ID NO: 118485 - RNA, 1758 nt, Artificial Sequence
  derived and/or modified sequence opt2 from hemagglutinin__InfluenzaB__AGQ16323
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccucccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118486 - RNA, 1755 nt, Artificial Sequence; identical to SEQ ID NO: 118366
  derived and/or modified sequence opt2 from hemagglutinin__InfluenzaB__AGQ16324

SEQ ID NO: 118487 - RNA, 1755 nt, Artificial Sequence; identical to SEQ ID NO: 118366
  derived and/or modified sequence opt2 from hemagglutinin__InfluenzaB__AGQ16325

SEQ ID NO: 118488 - RNA, 1755 nt, Artificial Sequence; identical to SEQ ID NO: 118366
  derived and/or modified sequence opt2 from hemagglutinin__InfluenzaB__AGQ16326

SEQ ID NO: 118489 - RNA, 1755 nt, Artificial Sequence; identical to SEQ ID NO: 118366
  derived and/or modified sequence opt2 from hemagglutinin__InfluenzaB__AGQ16327

SEQ ID NO: 118490 - RNA, 1758 nt, Artificial Sequence
  derived and/or modified sequence opt2 from hemagglutinin__InfluenzaB__AGQ16328
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagacccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118491 - RNA, 1758 nt, Artificial Sequence
  derived and/or modified sequence opt2 from hemagglutinin__InfluenzaB__AGX15487
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118492 - RNA, 1758 nt, Artificial Sequence; identical to SEQ ID NO: 118491
  derived and/or modified sequence opt2 from hemagglutinin__InfluenzaB__AGX15496

SEQ ID NO: 118493 - RNA, 1758 nt, Artificial Sequence
  derived and/or modified sequence opt2 from hemagglutinin__InfluenzaB__AGX15518
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccgcccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccuccgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118494 - RNA, 1758 nt, Artificial Sequence
  derived and/or modified sequence opt2 from hemagglutinin__InfluenzaB__AGX15529
augaaggccaucaucguccuccucauggucgucaccuccaacgccgaccgcgucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccucuacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcacccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118495 - RNA, 1758 nt, Artificial Sequence; identical to SEQ ID NO: 118085
  derived and/or modified sequence opt2 from hemagglutinin__InfluenzaB__AGX15541

SEQ ID NO: 118496 - RNA, 1758 nt, Artificial Sequence
  derived and/or modified sequence opt2 from hemagglutinin__InfluenzaB__AGX15552
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccaagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118497 - RNA, 1758 nt, Artificial Sequence; identical to SEQ ID NO: 118094
  derived and/or modified sequence opt2 from hemagglutinin__InfluenzaB__AGX15563

SEQ ID NO: 118498 - RNA, 1758 nt, Artificial Sequence; identical to SEQ ID NO: 118094
  derived and/or modified sequence opt2 from hemagglutinin__InfluenzaB__AGX15574

SEQ ID NO: 118499 - RNA, 1758 nt, Artificial Sequence
  derived and/or modified sequence opt2 from hemagglutinin__InfluenzaB__AGX15607
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacacccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118500 - RNA, 1758 nt, Artificial Sequence
  derived and/or modified sequence opt2 from hemagglutinin__InfluenzaB__AGX15629
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118501 - RNA, 1758 nt, Artificial Sequence
  derived and/or modified sequence opt2 from hemagglutinin__InfluenzaB__AGX15651
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118502 - RNA, 1758 nt, Artificial Sequence; identical to SEQ ID NO: 118501
  derived and/or modified sequence opt2 from hemagglutinin__InfluenzaB__AGX15675

SEQ ID NO: 118503 - RNA, 1758 nt, Artificial Sequence; identical to SEQ ID NO: 118501
  derived and/or modified sequence opt2 from hemagglutinin__InfluenzaB__AGX15686

SEQ ID NO: 118504 - RNA, 1758 nt, Artificial Sequence
  derived and/or modified sequence opt2 from hemagglutinin__InfluenzaB__AGX15697
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118505 - RNA, 1758 nt, Artificial Sequence; identical to SEQ ID NO: 118501
  derived and/or modified sequence opt2 from hemagglutinin__InfluenzaB__AGX15708

SEQ ID NO: 118506 - RNA, 1758 nt, Artificial Sequence; identical to SEQ ID NO: 118501
  derived and/or modified sequence opt2 from hemagglutinin__InfluenzaB__AGX15719

SEQ ID NO: 118507 - RNA, 1758 nt, Artificial Sequence; identical to SEQ ID NO: 118026
  derived and/or modified sequence opt2 from hemagglutinin__InfluenzaB__AGX15730

SEQ ID NO: 118508 - RNA, 1758 nt, Artificial Sequence; identical to SEQ ID NO: 118501
  derived and/or modified sequence opt2 from hemagglutinin__InfluenzaB__AGX15741

SEQ ID NO: 118509 - RNA, 1758 nt, Artificial Sequence; identical to SEQ ID NO: 118501
  derived and/or modified sequence opt2 from hemagglutinin__InfluenzaB__AGX15753

SEQ ID NO: 118510 - RNA, 1758 nt, Artificial Sequence
  derived and/or modified sequence opt2 from hemagglutinin__InfluenzaB__AGX15764
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccaucacccucaugaucgccaucuucgucgucuacauggucucccgcgacaacgucuccugcuccaucugccucuga

SEQ ID NO: 118511 - RNA, 1755 nt, Artificial Sequence
  derived and/or modified sequence opt2 from hemagglutinin__InfluenzaB__AGX15775
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagauccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118512 - RNA, 1758 nt, Artificial Sequence
  derived and/or modified sequence opt2 from hemagglutinin__InfluenzaB__AGX15786
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucuuccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118513 - RNA, 1758 nt, Artificial Sequence; identical to SEQ ID NO: 118501
  derived and/or modified sequence opt2 from hemagglutinin__InfluenzaB__AGX15797

SEQ ID NO: 118514 - RNA, 1758 nt, Artificial Sequence
  derived and/or modified sequence opt2 from hemagglutinin__InfluenzaB__AGX15808
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccaucggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118515 - RNA, 1758 nt, Artificial Sequence; identical to SEQ ID NO: 118120
  derived and/or modified sequence opt2 from hemagglutinin__InfluenzaB__AGX15830

SEQ ID NO: 118516 - RNA, 1758 nt, Artificial Sequence; identical to SEQ ID NO: 118120
  derived and/or modified sequence opt2 from hemagglutinin__InfluenzaB__AGX15841

SEQ ID NO: 118517 - RNA, 1758 nt, Artificial Sequence; identical to SEQ ID NO: 118120
  derived and/or modified sequence opt2 from hemagglutinin__InfluenzaB__AGX15852

SEQ ID NO: 118518 - RNA, 1758 nt, Artificial Sequence; identical to SEQ ID NO: 118120
  derived and/or modified sequence opt2 from hemagglutinin__InfluenzaB__AGX15863

SEQ ID NO: 118519 - RNA, 1758 nt, Artificial Sequence
  derived and/or modified sequence opt2 from hemagglutinin__InfluenzaB__AGX15874
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucaacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118520 - RNA, 1758 nt, Artificial Sequence; identical to SEQ ID NO: 118120
  derived and/or modified sequence opt2 from hemagglutinin__InfluenzaB__AGX15885

SEQ ID NO: 118521 - RNA, 1758 nt, Artificial Sequence
  derived and/or modified sequence opt2 from hemagglutinin__InfluenzaB__AGX15896
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccgcccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacggcgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118522 - RNA, 1758 nt, Artificial Sequence; identical to SEQ ID NO: 118120
  derived and/or modified sequence opt2 from hemagglutinin__InfluenzaB__AGX15907

SEQ ID NO: 118523 - RNA, 1758 nt, Artificial Sequence; identical to SEQ ID NO: 118120
  derived and/or modified sequence opt2 from hemagglutinin__InfluenzaB__AGX15918

SEQ ID NO: 118524 - RNA, 1758 nt, Artificial Sequence
  derived and/or modified sequence opt2 from hemagglutinin__InfluenzaB__AGX15929
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccaccaacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccgagaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118525 - RNA, 1758 nt, Artificial Sequence; identical to SEQ ID NO: 118120
  derived and/or modified sequence opt2 from hemagglutinin__InfluenzaB__AGX15940

SEQ ID NO: 118526 - RNA, 1758 nt, Artificial Sequence
  derived and/or modified sequence opt2 from hemagglutinin__InfluenzaB__AGX15962
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugaugcagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118527 - RNA, 1758 nt, Artificial Sequence; identical to SEQ ID NO: 118157
  derived and/or modified sequence opt2 from hemagglutinin__InfluenzaB__AGX15973

SEQ ID NO: 118528 - RNA, 1758 nt, Artificial Sequence; identical to SEQ ID NO: 118157
  derived and/or modified sequence opt2 from hemagglutinin__InfluenzaB__AGX15984

SEQ ID NO: 118529 - RNA, 1758 nt, Artificial Sequence; identical to SEQ ID NO: 118195
  derived and/or modified sequence opt2 from hemagglutinin__InfluenzaB__AGX15995

SEQ ID NO: 118530 - RNA, 1758 nt, Artificial Sequence; identical to SEQ ID NO: 118195
  derived and/or modified sequence opt2 from hemagglutinin__InfluenzaB__AGX16006

SEQ ID NO: 118531 - RNA, 1758 nt, Artificial Sequence
  derived and/or modified sequence opt2 from hemagglutinin__InfluenzaB__AGX16017
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118532 - RNA, 1755 nt, Artificial Sequence; identical to SEQ ID NO: 117938
  derived and/or modified sequence opt2 from hemagglutinin__InfluenzaB__AGX16028

SEQ ID NO: 118533 - RNA, 1755 nt, Artificial Sequence
  derived and/or modified sequence opt2 from hemagglutinin__InfluenzaB__AGX16039
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccgucgacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118534 - RNA, 1755 nt, Artificial Sequence
  derived and/or modified sequence opt2 from hemagglutinin__InfluenzaB__AGX16050
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118535 - RNA, 1755 nt, Artificial Sequence
  derived and/or modified sequence opt2 from hemagglutinin__InfluenzaB__AGX16061
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118536 - RNA, 1755 nt, Artificial Sequence
  derived and/or modified sequence opt2 from hemagglutinin__InfluenzaB__AGX16083
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118537 - RNA, 1755 nt, Artificial Sequence
  derived and/or modified sequence opt2 from hemagglutinin__InfluenzaB__AGX16105
augaaggccaucaucguccuccucauggucgucaccuccaacgccgaccgcaucugcaccggcaucaccuccuccuccuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacuccgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118538 - RNA, 1755 nt, Artificial Sequence
  derived and/or modified sequence opt2 from hemagglutinin__InfluenzaB__AGX16116
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgagaucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118539 - RNA, 1755 nt, Artificial Sequence
  derived and/or modified sequence opt2 from hemagglutinin__InfluenzaB__AGX16127
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgagaucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118540 - RNA, 1755 nt, Artificial Sequence; identical to SEQ ID NO: 118538
  derived and/or modified sequence opt2 from hemagglutinin__InfluenzaB__AGX16138

SEQ ID NO: 118541 - RNA, 1755 nt, Artificial Sequence; identical to SEQ ID NO: 118535
  derived and/or modified sequence opt2 from hemagglutinin__InfluenzaB__AGX16149

SEQ ID NO: 118542 - RNA, 1755 nt, Artificial Sequence; identical to SEQ ID NO: 118536
  derived and/or modified sequence opt2 from hemagglutinin__InfluenzaB__AGX16160

SEQ ID NO: 118543 - RNA, 1755 nt, Artificial Sequence; identical to SEQ ID NO: 118536
  derived and/or modified sequence opt2 from hemagglutinin__InfluenzaB__AGX16182

SEQ ID NO: 118544 - RNA, 1755 nt, Artificial Sequence; identical to SEQ ID NO: 117938
  derived and/or modified sequence opt2 from hemagglutinin__InfluenzaB__AGX16193

SEQ ID NO: 118545 - RNA, 1755 nt, Artificial Sequence; identical to SEQ ID NO: 117938
  derived and/or modified sequence opt2 from hemagglutinin__InfluenzaB__AGX16215

SEQ ID NO: 118546 - RNA, 1755 nt, Artificial Sequence; identical to SEQ ID NO: 117938
  derived and/or modified sequence opt2 from hemagglutinin__InfluenzaB__AGX16226

SEQ ID NO: 118547 - RNA, 1755 nt, Artificial Sequence
  derived and/or modified sequence opt2 from hemagglutinin__InfluenzaB__AGX16237
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccaucacccucaugcucgccaucuucaucgucuacauggucucccgcgacaacgucuccugcuccaucugccucuga

SEQ ID NO: 118548 - RNA, 1755 nt, Artificial Sequence; identical to SEQ ID NO: 117938
  derived and/or modified sequence opt2 from hemagglutinin__InfluenzaB__AGX16248

SEQ ID NO: 118549 - RNA, 1755 nt, Artificial Sequence; identical to SEQ ID NO: 117938
  derived and/or modified sequence opt2 from hemagglutinin__InfluenzaB__AGX16259

SEQ ID NO: 118550 - RNA, 1755 nt, Artificial Sequence
  derived and/or modified sequence opt2 from hemagglutinin__InfluenzaB__AGX16270
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118551 - RNA, 1755 nt, Artificial Sequence; identical to SEQ ID NO: 118550
  derived and/or modified sequence opt2 from hemagglutinin__InfluenzaB__AGX16281

SEQ ID NO: 118552 - RNA, 1755 nt, Artificial Sequence
  derived and/or modified sequence opt2 from hemagglutinin__InfluenzaB__AGX16292
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccaaccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcgcccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118553 - RNA, 1758 nt, Artificial Sequence; identical to SEQ ID NO: 118026
  derived and/or modified sequence opt2 from hemagglutinin__InfluenzaB__AGX16303

SEQ ID NO: 118554 - RNA, 1755 nt, Artificial Sequence; identical to SEQ ID NO: 117938
  derived and/or modified sequence opt2 from hemagglutinin__InfluenzaB__AGX16314

SEQ ID NO: 118555 - RNA, 1755 nt, Artificial Sequence; identical to SEQ ID NO: 117938
  derived and/or modified sequence opt2 from hemagglutinin__InfluenzaB__AGX16325

SEQ ID NO: 118556 - RNA, 1755 nt, Artificial Sequence; identical to SEQ ID NO: 118243
  derived and/or modified sequence opt2 from hemagglutinin__InfluenzaB__AGX16336

SEQ ID NO: 118557 - RNA, 1755 nt, Artificial Sequence; identical to SEQ ID NO: 118243
  derived and/or modified sequence opt2 from hemagglutinin__InfluenzaB__AGX16347

SEQ ID NO: 118558 - RNA, 1755 nt, Artificial Sequence; identical to SEQ ID NO: 118243
  derived and/or modified sequence opt2 from hemagglutinin__InfluenzaB__AGX16358

SEQ ID NO: 118559 - RNA, 1755 nt, Artificial Sequence
  derived and/or modified sequence opt2 from hemagglutinin__InfluenzaB__AGX16369
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118560 - RNA, 1755 nt, Artificial Sequence
  derived and/or modified sequence opt2 from hemagglutinin__InfluenzaB__AGX16380
augaaggccaucgucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcgccacccccuccgccaaggccuccauccuccacgagguccgccccgucaccuccggcugcuuccccaugaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118561 - RNA, 1755 nt, Artificial Sequence; identical to SEQ ID NO: 118079
  derived and/or modified sequence opt2 from hemagglutinin__InfluenzaB__AGX16391

SEQ ID NO: 118562 - RNA, 1755 nt, Artificial Sequence
  derived and/or modified sequence opt2 from hemagglutinin__InfluenzaB__AGX16402
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagccccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118563 - RNA, 1755 nt, Artificial Sequence; identical to SEQ ID NO: 118332
  derived and/or modified sequence opt2 from hemagglutinin__InfluenzaB__AGX16413

SEQ ID NO: 118564 - RNA, 1755 nt, Artificial Sequence; identical to SEQ ID NO: 118332
  derived and/or modified sequence opt2 from hemagglutinin__InfluenzaB__AGX16423

SEQ ID NO: 118565 - RNA, 1755 nt, Artificial Sequence; identical to SEQ ID NO: 118332
  derived and/or modified sequence opt2 from hemagglutinin__InfluenzaB__AGX16434

SEQ ID NO: 118566 - RNA, 1755 nt, Artificial Sequence; identical to SEQ ID NO: 118332
  derived and/or modified sequence opt2 from hemagglutinin__InfluenzaB__AGX16445

SEQ ID NO: 118567 - RNA, 1755 nt, Artificial Sequence; identical to SEQ ID NO: 118332
  derived and/or modified sequence opt2 from hemagglutinin__InfluenzaB__AGX16456

SEQ ID NO: 118568 - RNA, 1755 nt, Artificial Sequence
  derived and/or modified sequence opt2 from hemagglutinin__InfluenzaB__AGX16467
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118569 - RNA, 1755 nt, Artificial Sequence; identical to SEQ ID NO: 118332
  derived and/or modified sequence opt2 from hemagglutinin__InfluenzaB__AGX16478

SEQ ID NO: 118570 - RNA, 1755 nt, Artificial Sequence; identical to SEQ ID NO: 118079
  derived and/or modified sequence opt2 from hemagglutinin__InfluenzaB__AGX16489

SEQ ID NO: 118571 - RNA, 1758 nt, Artificial Sequence; identical to SEQ ID NO: 118491
  derived and/or modified sequence opt2 from hemagglutinin__InfluenzaB__AGX16500

SEQ ID NO: 118572 - RNA, 1758 nt, Artificial Sequence; identical to SEQ ID NO: 118491
  derived and/or modified sequence opt2 from hemagglutinin__InfluenzaB__AGX16511

SEQ ID NO: 118573 - RNA, 1758 nt, Artificial Sequence; identical to SEQ ID NO: 118491
  derived and/or modified sequence opt2 from hemagglutinin__InfluenzaB__AGX16522

SEQ ID NO: 118574 - RNA, 1758 nt, Artificial Sequence
  derived and/or modified sequence opt2 from hemagglutinin__InfluenzaB__AGX16533
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaaggagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118575 - RNA, 1758 nt, Artificial Sequence
  derived and/or modified sequence opt2 from hemagglutinin__InfluenzaB__AGX16555
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118576 - RNA, 1758 nt, Artificial Sequence
  derived and/or modified sequence opt2 from hemagglutinin__InfluenzaB__AGX16566
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118577 - RNA, 1758 nt, Artificial Sequence; identical to SEQ ID NO: 118491
  derived and/or modified sequence opt2 from hemagglutinin__InfluenzaB__AGX16577

SEQ ID NO: 118578 - RNA, 1758 nt, Artificial Sequence
  derived and/or modified sequence opt2 from hemagglutinin__InfluenzaB__AGX16588
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118579 - RNA, 1758 nt, Artificial Sequence; identical to SEQ ID NO: 118491
  derived and/or modified sequence opt2 from hemagglutinin__InfluenzaB__AGX16599

SEQ ID NO: 118580 - RNA, 1758 nt, Artificial Sequence; identical to SEQ ID NO: 118574
  derived and/or modified sequence opt2 from hemagglutinin__InfluenzaB__AGX16610

SEQ ID NO: 118581 - RNA, 1758 nt, Artificial Sequence; identical to SEQ ID NO: 118491
  derived and/or modified sequence opt2 from hemagglutinin__InfluenzaB__AGX16621

SEQ ID NO: 118582 - RNA, 1758 nt, Artificial Sequence
  derived and/or modified sequence opt2 from hemagglutinin__InfluenzaB__AGX16654
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaucaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118583 - RNA, 1758 nt, Artificial Sequence; identical to SEQ ID NO: 118491
  derived and/or modified sequence opt2 from hemagglutinin__InfluenzaB__AGX16665

SEQ ID NO: 118584 - RNA, 1758 nt, Artificial Sequence; identical to SEQ ID NO: 118491
  derived and/or modified sequence opt2 from hemagglutinin__InfluenzaB__AGX16676

SEQ ID NO: 118585 - RNA, 1758 nt, Artificial Sequence; identical to SEQ ID NO: 118491
  derived and/or modified sequence opt2 from hemagglutinin__InfluenzaB__AGX16687

SEQ ID NO: 118586 - RNA, 1758 nt, Artificial Sequence; identical to SEQ ID NO: 118491
  derived and/or modified sequence opt2 from hemagglutinin__InfluenzaB__AGX16698

SEQ ID NO: 118587 - RNA, 1758 nt, Artificial Sequence
  derived and/or modified sequence opt2 from hemagglutinin__InfluenzaB__AGX16709
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccgagaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118588 - RNA, 1758 nt, Artificial Sequence; identical to SEQ ID NO: 118491
  derived and/or modified sequence opt2 from hemagglutinin__InfluenzaB__AGX16720

SEQ ID NO: 118589 - RNA, 1758 nt, Artificial Sequence; identical to SEQ ID NO: 118491
  derived and/or modified sequence opt2 from hemagglutinin__InfluenzaB__AGX16731

SEQ ID NO: 118590 - RNA, 1758 nt, Artificial Sequence
  derived and/or modified sequence opt2 from hemagglutinin__InfluenzaB__AGX16742
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccaucauccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118591 - RNA, 1758 nt, Artificial Sequence; identical to SEQ ID NO: 118491
  derived and/or modified sequence opt2 from hemagglutinin__InfluenzaB__AGX16753

SEQ ID NO: 118592 - RNA, 1758 nt, Artificial Sequence; identical to SEQ ID NO: 118491
  derived and/or modified sequence opt2 from hemagglutinin__InfluenzaB__AGX16764

SEQ ID NO: 118593 - RNA, 1758 nt, Artificial Sequence; identical to SEQ ID NO: 118491
  derived and/or modified sequence opt2 from hemagglutinin__InfluenzaB__AGX16775

SEQ ID NO: 118594 - RNA, 1758 nt, Artificial Sequence
  derived and/or modified sequence opt2 from hemagglutinin__InfluenzaB__AGX16797
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacaugcccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118595 - RNA, 1758 nt, Artificial Sequence; identical to SEQ ID NO: 118491
  derived and/or modified sequence opt2 from hemagglutinin__InfluenzaB__AGX16808

SEQ ID NO: 118596 - RNA, 1758 nt, Artificial Sequence
  derived and/or modified sequence opt2 from hemagglutinin__InfluenzaB__AGX16819
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 118597 - RNA, 1758 nt, Artificial Sequence; identical to SEQ ID NO: 118491
  derived and/or modified sequence opt2 from hemagglutinin__InfluenzaB__AGX16830

SEQ ID NO: 118598 - RNA, 1758 nt, Artificial Sequence
  derived and/or modified sequence opt2 from hemagglutinin__InfluenzaB__AGX16841
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcaugaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacggcgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118599 - RNA, 1758 nt, Artificial Sequence
  derived and/or modified sequence opt2 from hemagglutinin__InfluenzaB__AGX16852
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgcaucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118600 - RNA, 1758 nt, Artificial Sequence; identical to SEQ ID NO: 118491
  derived and/or modified sequence opt2 from hemagglutinin__InfluenzaB__AGX16863

SEQ ID NO: 118601 - RNA, 1758 nt, Artificial Sequence; identical to SEQ ID NO: 118491
  derived and/or modified sequence opt2 from hemagglutinin__InfluenzaB__AGX16874

SEQ ID NO: 118602 - RNA, 1758 nt, Artificial Sequence
  derived and/or modified sequence opt2 from hemagglutinin__InfluenzaB__AGX16885
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118603 - RNA, 1758 nt, Artificial Sequence; identical to SEQ ID NO: 118602
  derived and/or modified sequence opt2 from hemagglutinin__InfluenzaB__AGX16896

SEQ ID NO: 118604 - RNA, 1758 nt, Artificial Sequence; identical to SEQ ID NO: 118491
  derived and/or modified sequence opt2 from hemagglutinin__InfluenzaB__AGX16907

SEQ ID NO: 118605 - RNA, 1758 nt, Artificial Sequence; identical to SEQ ID NO: 118576
  derived and/or modified sequence opt2 from hemagglutinin__InfluenzaB__AGX16918

SEQ ID NO: 118606 - RNA, 1758 nt, Artificial Sequence; identical to SEQ ID NO: 118491
  derived and/or modified sequence opt2 from hemagglutinin__InfluenzaB__AGX16940

SEQ ID NO: 118607 - RNA, 1758 nt, Artificial Sequence; identical to SEQ ID NO: 118602
  derived and/or modified sequence opt2 from hemagglutinin__InfluenzaB__AGX16951

SEQ ID NO: 118608 - RNA, 1758 nt, Artificial Sequence
  derived and/or modified sequence opt2 from hemagglutinin__InfluenzaB__AGX16962
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccgagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaaggaggacggcggccucccccaguccggccgcaucgucgucgacuacaugguccagaaguccggcaacaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118609 - RNA, 1758 nt, Artificial Sequence; identical to SEQ ID NO: 118491
  derived and/or modified sequence opt2 from hemagglutinin__InfluenzaB__AGX16973

SEQ ID NO: 118610 - RNA, 1758 nt, Artificial Sequence
  derived and/or modified sequence opt2 from hemagglutinin__InfluenzaB__AGX16995
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccgucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118611 - RNA, 1758 nt, Artificial Sequence
  derived and/or modified sequence opt2 from hemagglutinin__InfluenzaB__AGX17006
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118612 - RNA, 1758 nt, Artificial Sequence; identical to SEQ ID NO: 118491
  derived and/or modified sequence opt2 from hemagglutinin__InfluenzaB__AGX17017

SEQ ID NO: 118613 - RNA, 1758 nt, Artificial Sequence; identical to SEQ ID NO: 118491
  derived and/or modified sequence opt2 from hemagglutinin__InfluenzaB__AGX17028

SEQ ID NO: 118614 - RNA, 1758 nt, Artificial Sequence
  derived and/or modified sequence opt2 from hemagglutinin__InfluenzaB__AGX17039
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccgagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaacaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccaucaugcucuacuacuccaccgccgccuccucccucgccgucacccucaugaucgccaucuucgucgucuacauggucucccgcgacaacgucuccugcuccaucugccucuga

SEQ ID NO: 118615 - RNA, 1758 nt, Artificial Sequence; identical to SEQ ID NO: 118491
  derived and/or modified sequence opt2 from hemagglutinin__InfluenzaB__AGX17050

SEQ ID NO: 118616 - RNA, 1758 nt, Artificial Sequence
  derived and/or modified sequence opt2 from hemagglutinin__InfluenzaB__AGX17061
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcgcauccgccucuccaaccacaacgucaucaacgccgagaaggcccccggcggccccuacaagaucggcaccuccggcuccugccccaacgucaccaacggcaacggcuucuucgccaccauggccugggccguccccaagaacgagaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118617 - RNA, 1758 nt, Artificial Sequence
  derived and/or modified sequence opt2 from hemagglutinin__InfluenzaB__AGX17072
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccgagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaacaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118618 - RNA, 1758 nt, Artificial Sequence; identical to SEQ ID NO: 118602
  derived and/or modified sequence opt2 from hemagglutinin__InfluenzaB__AGX17083

SEQ ID NO: 118619 - RNA, 1758 nt, Artificial Sequence
  derived and/or modified sequence opt2 from hemagglutinin__InfluenzaB__AGX17094
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118620 - RNA, 1758 nt, Artificial Sequence
  derived and/or modified sequence opt2 from hemagglutinin__InfluenzaB__AGX17105
augaaggccaucaucguccuccucauggucgucaccuccaacgccgaccgcaucugcaccggcaucaccuccuccaacuccccccacgucgucaagaccgccacccagggcgagaucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgaggucccccacaucugcaccgagggcgaggaccagaucaccgucuggggcuuccacuccgacaacgagauccagauggccaagcucuacggcgacuccaagccccagaaguucaccuccuccgccaacggcgucaccacccacuacaucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118621 - RNA, 1758 nt, Artificial Sequence; identical to SEQ ID NO: 118602
  derived and/or modified sequence opt2 from hemagglutinin__InfluenzaB__AGX17116

SEQ ID NO: 118622 - RNA, 1758 nt, Artificial Sequence
  derived and/or modified sequence opt2 from hemagglutinin__InfluenzaB__AGX17127
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccgagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaacaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118623 - RNA, 1758 nt, Artificial Sequence; identical to SEQ ID NO: 118611
  derived and/or modified sequence opt2 from hemagglutinin__InfluenzaB__AGX17138

SEQ ID NO: 118624 - RNA, 1758 nt, Artificial Sequence; identical to SEQ ID NO: 118611
  derived and/or modified sequence opt2 from hemagglutinin__InfluenzaB__AGX17149

SEQ ID NO: 118625 - RNA, 1758 nt, Artificial Sequence
  derived and/or modified sequence opt2 from hemagglutinin__InfluenzaB__AGX17160
augaaggccaucaucguccuccucauggucgucaccuccaacgccgaccgcaucugcaccggcaucaccuccuccaacuccccccacgucgucaagaccgccacccagggcgaggucaacgucaccggcaugaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118626 - RNA, 1758 nt, Artificial Sequence
  derived and/or modified sequence opt2 from hemagglutinin__InfluenzaB__AGX17171
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccgagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacaaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaacaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118627 - RNA, 1758 nt, Artificial Sequence; identical to SEQ ID NO: 118491
  derived and/or modified sequence opt2 from hemagglutinin__InfluenzaB__AGX17182

SEQ ID NO: 118628 - RNA, 1758 nt, Artificial Sequence; identical to SEQ ID NO: 118491
  derived and/or modified sequence opt2 from hemagglutinin__InfluenzaB__AGX17193

SEQ ID NO: 118629 - RNA, 1758 nt, Artificial Sequence; identical to SEQ ID NO: 118491
  derived and/or modified sequence opt2 from hemagglutinin__InfluenzaB__AGX17204

SEQ ID NO: 118630 - RNA, 1758 nt, Artificial Sequence
  derived and/or modified sequence opt2 from hemagglutinin__InfluenzaB__AGX17215
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118631 - RNA, 1758 nt, Artificial Sequence; identical to SEQ ID NO: 118491
  derived and/or modified sequence opt2 from hemagglutinin__InfluenzaB__AGX17226

SEQ ID NO: 118632 - RNA, 1758 nt, Artificial Sequence
  derived and/or modified sequence opt2 from hemagglutinin__InfluenzaB__AGX17237
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacaucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118633 - RNA, 1758 nt, Artificial Sequence
  derived and/or modified sequence opt2 from hemagglutinin__InfluenzaB__AGX17248
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118634 - RNA, 1758 nt, Artificial Sequence; identical to SEQ ID NO: 118575
  derived and/or modified sequence opt2 from hemagglutinin__InfluenzaB__AGX17270

SEQ ID NO: 118635 - RNA, 1758 nt, Artificial Sequence; identical to SEQ ID NO: 118491
  derived and/or modified sequence opt2 from hemagglutinin__InfluenzaB__AGX17281

SEQ ID NO: 118636 - RNA, 1758 nt, Artificial Sequence; identical to SEQ ID NO: 118491
  derived and/or modified sequence opt2 from hemagglutinin__InfluenzaB__AGX17292

SEQ ID NO: 118637 - RNA, 1758 nt, Artificial Sequence; identical to SEQ ID NO: 118491
  derived and/or modified sequence opt2 from hemagglutinin__InfluenzaB__AGX17303

SEQ ID NO: 118638 - RNA, 1758 nt, Artificial Sequence; identical to SEQ ID NO: 118617
  derived and/or modified sequence opt2 from hemagglutinin__InfluenzaB__AGX17314

SEQ ID NO: 118639 - RNA, 1758 nt, Artificial Sequence; identical to SEQ ID NO: 118491
  derived and/or modified sequence opt2 from hemagglutinin__InfluenzaB__AGX17325

SEQ ID NO: 118640 - RNA, 1758 nt, Artificial Sequence; identical to SEQ ID NO: 118602
  derived and/or modified sequence opt2 from hemagglutinin__InfluenzaB__AGX17336

SEQ ID NO: 118641 - RNA, 1758 nt, Artificial Sequence; identical to SEQ ID NO: 118491
  derived and/or modified sequence opt2 from hemagglutinin__InfluenzaB__AGX17347

SEQ ID NO: 118642 - RNA, 1758 nt, Artificial Sequence; identical to SEQ ID NO: 118491
  derived and/or modified sequence opt2 from hemagglutinin__InfluenzaB__AGX17358

SEQ ID NO: 118643 - RNA, 1758 nt, Artificial Sequence
  derived and/or modified sequence opt2 from hemagglutinin__InfluenzaB__AGX17369
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgccgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118644 - RNA, 1758 nt, Artificial Sequence; identical to SEQ ID NO: 118617
  derived and/or modified sequence opt2 from hemagglutinin__InfluenzaB__AGX17380

SEQ ID NO: 118645 - RNA, 1758 nt, Artificial Sequence; identical to SEQ ID NO: 118491
  derived and/or modified sequence opt2 from hemagglutinin__InfluenzaB__AGX17391

SEQ ID NO: 118646 - RNA, 1758 nt, Artificial Sequence
  derived and/or modified sequence opt2 from hemagglutinin__InfluenzaB__AGX17400
augaaggccaucaucguccuccucauggucgucaccuccaacgccgaccgcaucugcaccggcaucaccuccuccaacuccccccacauggucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118647 - RNA, 1758 nt, Artificial Sequence; identical to SEQ ID NO: 118491
  derived and/or modified sequence opt2 from hemagglutinin__InfluenzaB__AGX17411

SEQ ID NO: 118648 - RNA, 1758 nt, Artificial Sequence; identical to SEQ ID NO: 118491
  derived and/or modified sequence opt2 from hemagglutinin__InfluenzaB__AGX17422

SEQ ID NO: 118649 - RNA, 1758 nt, Artificial Sequence; identical to SEQ ID NO: 118574
  derived and/or modified sequence opt2 from hemagglutinin__InfluenzaB__AGX17433

SEQ ID NO: 118650 - RNA, 1758 nt, Artificial Sequence; identical to SEQ ID NO: 118491
  derived and/or modified sequence opt2 from hemagglutinin__InfluenzaB__AGX17444

SEQ ID NO: 118651 - RNA, 1758 nt, Artificial Sequence; identical to SEQ ID NO: 118574
  derived and/or modified sequence opt2 from hemagglutinin__InfluenzaB__AGX17455

SEQ ID NO: 118652 - RNA, 1758 nt, Artificial Sequence; identical to SEQ ID NO: 118617
  derived and/or modified sequence opt2 from hemagglutinin__InfluenzaB__AGX17466

SEQ ID NO: 118653 - RNA, 1758 nt, Artificial Sequence; identical to SEQ ID NO: 118491
  derived and/or modified sequence opt2 from hemagglutinin__InfluenzaB__AGX17477

SEQ ID NO: 118654 - RNA, 1758 nt, Artificial Sequence; identical to SEQ ID NO: 118576
  derived and/or modified sequence opt2 from hemagglutinin__InfluenzaB__AGX17488

SEQ ID NO: 118655 - RNA, 1758 nt, Artificial Sequence; identical to SEQ ID NO: 118491
  derived and/or modified sequence opt2 from hemagglutinin__InfluenzaB__AGX17499

SEQ ID NO: 118656 - RNA, 1758 nt, Artificial Sequence; identical to SEQ ID NO: 118617
  derived and/or modified sequence opt2 from hemagglutinin__InfluenzaB__AGX17510

SEQ ID NO: 118657 - RNA, 1758 nt, Artificial Sequence; identical to SEQ ID NO: 118617
  derived and/or modified sequence opt2 from hemagglutinin__InfluenzaB__AGX17521

SEQ ID NO: 118658 - RNA, 1758 nt, Artificial Sequence; identical to SEQ ID NO: 118619
  derived and/or modified sequence opt2 from hemagglutinin__InfluenzaB__AGX17532

SEQ ID NO: 118659 - RNA, 1758 nt, Artificial Sequence
  derived and/or modified sequence opt2 from hemagglutinin__InfluenzaB__AGX17543
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccucccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccaugaacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118660 - RNA, 1758 nt, Artificial Sequence
  derived and/or modified sequence opt2 from hemagglutinin__InfluenzaB__AGX17554
augaaggccaucaucguccuccuccucgucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118661 - RNA, 1755 nt, Artificial Sequence; identical to SEQ ID NO: 118535
  derived and/or modified sequence opt2 from hemagglutinin__InfluenzaB__AGX17565

SEQ ID NO: 118662 - RNA, 1758 nt, Artificial Sequence
  derived and/or modified sequence opt2 from hemagglutinin__InfluenzaB__AGX17576
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugauggccaucuucgucgucuacauggucucccgcgacaacgucuccugcuccaucugccucuga

SEQ ID NO: 118663 - RNA, 1758 nt, Artificial Sequence; identical to SEQ ID NO: 118026
  derived and/or modified sequence opt2 from hemagglutinin__InfluenzaB__AGX17598

SEQ ID NO: 118664 - RNA, 1758 nt, Artificial Sequence
  derived and/or modified sequence opt2 from hemagglutinin__InfluenzaB__AGX17609
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118665 - RNA, 1758 nt, Artificial Sequence; identical to SEQ ID NO: 118493
  derived and/or modified sequence opt2 from hemagglutinin__InfluenzaB__AGX17620

SEQ ID NO: 118666 - RNA, 1758 nt, Artificial Sequence; identical to SEQ ID NO: 118026
  derived and/or modified sequence opt2 from hemagglutinin__InfluenzaB__AGX17631

SEQ ID NO: 118667 - RNA, 1758 nt, Artificial Sequence; identical to SEQ ID NO: 118150
  derived and/or modified sequence opt2 from hemagglutinin__InfluenzaB__AGX17642

SEQ ID NO: 118668 - RNA, 1758 nt, Artificial Sequence; identical to SEQ ID NO: 118493
  derived and/or modified sequence opt2 from hemagglutinin__InfluenzaB__AGX17653

SEQ ID NO: 118669 - RNA, 1758 nt, Artificial Sequence; identical to SEQ ID NO: 118026
  derived and/or modified sequence opt2 from hemagglutinin__InfluenzaB__AGX17664

SEQ ID NO: 118670 - RNA, 1758 nt, Artificial Sequence; identical to SEQ ID NO: 118150
  derived and/or modified sequence opt2 from hemagglutinin__InfluenzaB__AGX17675

SEQ ID NO: 118671 - RNA, 1758 nt, Artificial Sequence; identical to SEQ ID NO: 118493
  derived and/or modified sequence opt2 from hemagglutinin__InfluenzaB__AGX17686

SEQ ID NO: 118672 - RNA, 1758 nt, Artificial Sequence
  derived and/or modified sequence opt2 from hemagglutinin__InfluenzaB__AGX17697
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcgagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgccaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118673 - RNA, 1758 nt, Artificial Sequence; identical to SEQ ID NO: 118150
  derived and/or modified sequence opt2 from hemagglutinin__InfluenzaB__AGX17708

SEQ ID NO: 118674 - RNA, 1758 nt, Artificial Sequence; identical to SEQ ID NO: 118493
  derived and/or modified sequence opt2 from hemagglutinin__InfluenzaB__AGX17719

SEQ ID NO: 118675 - RNA, 1758 nt, Artificial Sequence; identical to SEQ ID NO: 118150
  derived and/or modified sequence opt2 from hemagglutinin__InfluenzaB__AGX17730

SEQ ID NO: 118676 - RNA, 1758 nt, Artificial Sequence; identical to SEQ ID NO: 118026
  derived and/or modified sequence opt2 from hemagglutinin__InfluenzaB__AGX17741

SEQ ID NO: 118677 - RNA, 1758 nt, Artificial Sequence; identical to SEQ ID NO: 118493
  derived and/or modified sequence opt2 from hemagglutinin__InfluenzaB__AGX17752

SEQ ID NO: 118678 - RNA, 1758 nt, Artificial Sequence; identical to SEQ ID NO: 118493
  derived and/or modified sequence opt2 from hemagglutinin__InfluenzaB__AGX17774

SEQ ID NO: 118679 - RNA, 1758 nt, Artificial Sequence
  derived and/or modified sequence opt2 from hemagglutinin__InfluenzaB__AGX17785
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118680 - RNA, 1758 nt, Artificial Sequence; identical to SEQ ID NO: 118493
  derived and/or modified sequence opt2 from hemagglutinin__InfluenzaB__AGX17796

SEQ ID NO: 118681 - RNA, 1758 nt, Artificial Sequence; identical to SEQ ID NO: 118077
  derived and/or modified sequence opt2 from hemagglutinin__InfluenzaB__AGX17807

SEQ ID NO: 118682 - RNA, 1758 nt, Artificial Sequence; identical to SEQ ID NO: 118664
  derived and/or modified sequence opt2 from hemagglutinin__InfluenzaB__AGX17818

SEQ ID NO: 118683 - RNA, 1758 nt, Artificial Sequence
  derived and/or modified sequence opt2 from hemagglutinin__InfluenzaB__AGX17829
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccgucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118684 - RNA, 1758 nt, Artificial Sequence; identical to SEQ ID NO: 118150
  derived and/or modified sequence opt2 from hemagglutinin__InfluenzaB__AGX17840

SEQ ID NO: 118685 - RNA, 1758 nt, Artificial Sequence; identical to SEQ ID NO: 118493
  derived and/or modified sequence opt2 from hemagglutinin__InfluenzaB__AGX17851

SEQ ID NO: 118686 - RNA, 1758 nt, Artificial Sequence
  derived and/or modified sequence opt2 from hemagglutinin__InfluenzaB__AGX17862
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcacccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118687 - RNA, 1758 nt, Artificial Sequence
  derived and/or modified sequence opt2 from hemagglutinin__InfluenzaB__AGX17873
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucgacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118688 - RNA, 1758 nt, Artificial Sequence; identical to SEQ ID NO: 118150
  derived and/or modified sequence opt2 from hemagglutinin__InfluenzaB__AGX17884

SEQ ID NO: 118689 - RNA, 1758 nt, Artificial Sequence
  derived and/or modified sequence opt2 from hemagglutinin__InfluenzaB__AGX17895
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118690 - RNA, 1758 nt, Artificial Sequence; identical to SEQ ID NO: 118150
  derived and/or modified sequence opt2 from hemagglutinin__InfluenzaB__AGX17906

SEQ ID NO: 118691 - RNA, 1758 nt, Artificial Sequence; identical to SEQ ID NO: 118150
  derived and/or modified sequence opt2 from hemagglutinin__InfluenzaB__AGX17917

SEQ ID NO: 118692 - RNA, 1758 nt, Artificial Sequence
  derived and/or modified sequence opt2 from hemagglutinin__InfluenzaB__AGX17928
augaagaccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcacccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118693 - RNA, 1758 nt, Artificial Sequence; identical to SEQ ID NO: 118026
  derived and/or modified sequence opt2 from hemagglutinin__InfluenzaB__AGX17939

SEQ ID NO: 118694 - RNA, 1758 nt, Artificial Sequence; identical to SEQ ID NO: 118026
  derived and/or modified sequence opt2 from hemagglutinin__InfluenzaB__AGX17950

SEQ ID NO: 118695 - RNA, 1758 nt, Artificial Sequence; identical to SEQ ID NO: 118026
  derived and/or modified sequence opt2 from hemagglutinin__InfluenzaB__AGX17961

SEQ ID NO: 118696 - RNA, 1758 nt, Artificial Sequence; identical to SEQ ID NO: 118493
  derived and/or modified sequence opt2 from hemagglutinin__InfluenzaB__AGX17972

SEQ ID NO: 118697 - RNA, 1758 nt, Artificial Sequence; identical to SEQ ID NO: 118026
  derived and/or modified sequence opt2 from hemagglutinin__InfluenzaB__AGX17983

SEQ ID NO: 118698 - RNA, 1758 nt, Artificial Sequence; identical to SEQ ID NO: 118150
  derived and/or modified sequence opt2 from hemagglutinin__InfluenzaB__AGX17994

SEQ ID NO: 118699 - RNA, 1758 nt, Artificial Sequence
  derived and/or modified sequence opt2 from hemagglutinin__InfluenzaB__AGX18005
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgacaucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118700 - RNA, 1758 nt, Artificial Sequence
  derived and/or modified sequence opt2 from hemagglutinin__InfluenzaB__AGX18016
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaucgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118701 - RNA, 1758 nt, Artificial Sequence; identical to SEQ ID NO: 118664
  derived and/or modified sequence opt2 from hemagglutinin__InfluenzaB__AGX18027

SEQ ID NO: 118702 - RNA, 1758 nt, Artificial Sequence; identical to SEQ ID NO: 118150
  derived and/or modified sequence opt2 from hemagglutinin__InfluenzaB__AGX18038

SEQ ID NO: 118703 - RNA, 1758 nt, Artificial Sequence; identical to SEQ ID NO: 118150
  derived and/or modified sequence opt2 from hemagglutinin__InfluenzaB__AGX18049

SEQ ID NO: 118704 - RNA, 1758 nt, Artificial Sequence; identical to SEQ ID NO: 118150
  derived and/or modified sequence opt2 from hemagglutinin__InfluenzaB__AGX18060

SEQ ID NO: 118705 - RNA, 1758 nt, Artificial Sequence; identical to SEQ ID NO: 118026
  derived and/or modified sequence opt2 from hemagglutinin__InfluenzaB__AGX18071

SEQ ID NO: 118706 - RNA, 1758 nt, Artificial Sequence; identical to SEQ ID NO: 118686
  derived and/or modified sequence opt2 from hemagglutinin__InfluenzaB__AGX18082

SEQ ID NO: 118707 - RNA, 1758 nt, Artificial Sequence; identical to SEQ ID NO: 118686
  derived and/or modified sequence opt2 from hemagglutinin__InfluenzaB__AGX18093

SEQ ID NO: 118708 - RNA, 1758 nt, Artificial Sequence; identical to SEQ ID NO: 118493
  derived and/or modified sequence opt2 from hemagglutinin__InfluenzaB__AGX18104

SEQ ID NO: 118709 - RNA, 1758 nt, Artificial Sequence; identical to SEQ ID NO: 118150
  derived and/or modified sequence opt2 from hemagglutinin__InfluenzaB__AGX18115

SEQ ID NO: 118710 - RNA, 1758 nt, Artificial Sequence; identical to SEQ ID NO: 118150
  derived and/or modified sequence opt2 from hemagglutinin__InfluenzaB__AGX18126

SEQ ID NO: 118711 - RNA, 1758 nt, Artificial Sequence; identical to SEQ ID NO: 118026
  derived and/or modified sequence opt2 from hemagglutinin__InfluenzaB__AGX18137

SEQ ID NO: 118712 - RNA, 1758 nt, Artificial Sequence; identical to SEQ ID NO: 118686
  derived and/or modified sequence opt2 from hemagglutinin__InfluenzaB__AGX18148

SEQ ID NO: 118713 - RNA, 1758 nt, Artificial Sequence; identical to SEQ ID NO: 118026
  derived and/or modified sequence opt2 from hemagglutinin__InfluenzaB__AGX18159

SEQ ID NO: 118714 - RNA, 1758 nt, Artificial Sequence; identical to SEQ ID NO: 118026
  derived and/or modified sequence opt2 from hemagglutinin__InfluenzaB__AGX18170

SEQ ID NO: 118715 - RNA, 1758 nt, Artificial Sequence; identical to SEQ ID NO: 118686
  derived and/or modified sequence opt2 from hemagglutinin__InfluenzaB__AGX18181

SEQ ID NO: 118716 - RNA, 1758 nt, Artificial Sequence
  derived and/or modified sequence opt2 from hemagglutinin__InfluenzaB__AGX18192
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccaccaacggcgucaccacccacuacgucucccagaucggcggcuuccccaaccagaccgaggacggcggccucccccaguccggccgcaucgucgucgacuacaugguccagaagcccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccuccgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118717 - RNA, 1758 nt, Artificial Sequence; identical to SEQ ID NO: 118664
  derived and/or modified sequence opt2 from hemagglutinin__InfluenzaB__AGX18203

SEQ ID NO: 118718 - RNA, 1758 nt, Artificial Sequence
  derived and/or modified sequence opt2 from hemagglutinin__InfluenzaB__AGX18214
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaccggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaucauccuccucuacuacuccaccgccgccuccucccucgccgucacccucaugaucgccaucuucgucgucuacauggucucccgcgacaacgucuccugcuccaucugccucuga

SEQ ID NO: 118719 - RNA, 1758 nt, Artificial Sequence
  derived and/or modified sequence opt2 from hemagglutinin__InfluenzaB__AGX18225
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaaccgcaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118720 - RNA, 1758 nt, Artificial Sequence
  derived and/or modified sequence opt2 from hemagglutinin__InfluenzaB__AGX18236
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugaugcagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118721 - RNA, 1758 nt, Artificial Sequence; identical to SEQ ID NO: 118077
  derived and/or modified sequence opt2 from hemagglutinin__InfluenzaB__AGX18247

SEQ ID NO: 118722 - RNA, 1758 nt, Artificial Sequence
  derived and/or modified sequence opt2 from hemagglutinin__InfluenzaB__AGX18258
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaagaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcacccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118723 - RNA, 1758 nt, Artificial Sequence; identical to SEQ ID NO: 118026
  derived and/or modified sequence opt2 from hemagglutinin__InfluenzaB__AGX18280

SEQ ID NO: 118724 - RNA, 1758 nt, Artificial Sequence
  derived and/or modified sequence opt2 from hemagglutinin__InfluenzaB__AGX18291
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgucuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118725 - RNA, 1758 nt, Artificial Sequence
  derived and/or modified sequence opt2 from hemagglutinin__InfluenzaB__AGX18302
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacaagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcacccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118726 - RNA, 1758 nt, Artificial Sequence; identical to SEQ ID NO: 118026
  derived and/or modified sequence opt2 from hemagglutinin__InfluenzaB__AGX18313

SEQ ID NO: 118727 - RNA, 1758 nt, Artificial Sequence
  derived and/or modified sequence opt2 from hemagglutinin__InfluenzaB__AGX18324
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118728 - RNA, 1758 nt, Artificial Sequence; identical to SEQ ID NO: 118686
  derived and/or modified sequence opt2 from hemagglutinin__InfluenzaB__AGX18335

SEQ ID NO: 118729 - RNA, 1758 nt, Artificial Sequence
  derived and/or modified sequence opt2 from hemagglutinin__InfluenzaB__AGX18346
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgaggacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118730 - RNA, 1758 nt, Artificial Sequence
  derived and/or modified sequence opt2 from hemagglutinin__InfluenzaB__AGX18357
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccgcccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaaggagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccuccgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118731 - RNA, 1758 nt, Artificial Sequence
  derived and/or modified sequence opt2 from hemagglutinin__InfluenzaB__AGX18368
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccgcccccaccaagucccacuucgccaaccucaagggcaccaagacccgcggcaagcucugccccaagugccucaacugcaccgaccucgacgucgcccucggccgccccaagugcaccggcaacacccccuccgccgaggucuccauccuccacgagguccgccccgucaccuccggcugcuuccccaucaugcacgaccgcaccaagauccgccagcuccccaaccuccuccgcggcuacgagcacauccgccucuccaaccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccuccgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118732 - RNA, 1758 nt, Artificial Sequence; identical to SEQ ID NO: 118150
  derived and/or modified sequence opt2 from hemagglutinin__InfluenzaB__AGX18379

SEQ ID NO: 118733 - RNA, 1758 nt, Artificial Sequence; identical to SEQ ID NO: 118686
  derived and/or modified sequence opt2 from hemagglutinin__InfluenzaB__AGX18390

SEQ ID NO: 118734 - RNA, 1758 nt, Artificial Sequence
  derived and/or modified sequence opt2 from hemagglutinin__InfluenzaB__AGX18401
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccgcccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccuccgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118735 - RNA, 1758 nt, Artificial Sequence
  derived and/or modified sequence opt2 from hemagglutinin__InfluenzaB__AGX18412
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccaaccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118736 - RNA, 1758 nt, Artificial Sequence; identical to SEQ ID NO: 118493
  derived and/or modified sequence opt2 from hemagglutinin__InfluenzaB__AGX18423

SEQ ID NO: 118737 - RNA, 1755 nt, Artificial Sequence
  derived and/or modified sequence opt2 from hemagglutinin__InfluenzaB__AGX18424
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaucaagucccacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccucggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118738 - RNA, 1758 nt, Artificial Sequence
  derived and/or modified sequence opt2 from hemagglutinin__InfluenzaB__AGX18435
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118739 - RNA, 1758 nt, Artificial Sequence; identical to SEQ ID NO: 118150
  derived and/or modified sequence opt2 from hemagglutinin__InfluenzaB__AGX18446

SEQ ID NO: 118740 - RNA, 1758 nt, Artificial Sequence; identical to SEQ ID NO: 118686
  derived and/or modified sequence opt2 from hemagglutinin__InfluenzaB__AGX18457

SEQ ID NO: 118741 - RNA, 1758 nt, Artificial Sequence; identical to SEQ ID NO: 118493
  derived and/or modified sequence opt2 from hemagglutinin__InfluenzaB__AGX18468

SEQ ID NO: 118742 - RNA, 1758 nt, Artificial Sequence; identical to SEQ ID NO: 118686
  derived and/or modified sequence opt2 from hemagglutinin__InfluenzaB__AGX18479

SEQ ID NO: 118743 - RNA, 1758 nt, Artificial Sequence; identical to SEQ ID NO: 118026
  derived and/or modified sequence opt2 from hemagglutinin__InfluenzaB__AGX18490

SEQ ID NO: 118744 - RNA, 1758 nt, Artificial Sequence
  derived and/or modified sequence opt2 from hemagglutinin__InfluenzaB__AGX18512
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggccgccucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118745 - RNA, 1758 nt, Artificial Sequence; identical to SEQ ID NO: 118026
  derived and/or modified sequence opt2 from hemagglutinin__InfluenzaB__AGX18523

SEQ ID NO: 118746 - RNA, 1758 nt, Artificial Sequence; identical to SEQ ID NO: 118026
  derived and/or modified sequence opt2 from hemagglutinin__InfluenzaB__AGX18534

SEQ ID NO: 118747 - RNA, 1758 nt, Artificial Sequence; identical to SEQ ID NO: 118087
  derived and/or modified sequence opt2 from hemagglutinin__InfluenzaB__AGX18545

SEQ ID NO: 118748 - RNA, 1758 nt, Artificial Sequence; identical to SEQ ID NO: 118026
  derived and/or modified sequence opt2 from hemagglutinin__InfluenzaB__AGX18556

SEQ ID NO: 118749 - RNA, 1758 nt, Artificial Sequence; identical to SEQ ID NO: 118026
  derived and/or modified sequence opt2 from hemagglutinin__InfluenzaB__AGX18567

SEQ ID NO: 118750 - RNA, 1758 nt, Artificial Sequence
  derived and/or modified sequence opt2 from hemagglutinin__InfluenzaB__AGX18578
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaaggagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118751 - RNA, 1758 nt, Artificial Sequence
  derived and/or modified sequence opt2 from hemagglutinin__InfluenzaB__AGX18589
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaccgagacccagauggccaagcucuacggcgacuccaagccccagaaguucaccuccuccgccaacggcgucaccacccacuacgucucccagaucggcgacuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118752 - RNA, 1758 nt, Artificial Sequence; identical to SEQ ID NO: 118026
  derived and/or modified sequence opt2 from hemagglutinin__InfluenzaB__AGX18600

SEQ ID NO: 118753 - RNA, 1758 nt, Artificial Sequence; identical to SEQ ID NO: 118026
  derived and/or modified sequence opt2 from hemagglutinin__InfluenzaB__AGX18611

SEQ ID NO: 118754 - RNA, 1758 nt, Artificial Sequence; identical to SEQ ID NO: 118026
  derived and/or modified sequence opt2 from hemagglutinin__InfluenzaB__AGX18622

SEQ ID NO: 118755 - RNA, 1758 nt, Artificial Sequence; identical to SEQ ID NO: 118026
  derived and/or modified sequence opt2 from hemagglutinin__InfluenzaB__AGX18633

SEQ ID NO: 118756 - RNA, 1758 nt, Artificial Sequence; identical to SEQ ID NO: 118026
  derived and/or modified sequence opt2 from hemagglutinin__InfluenzaB__AGX18644

SEQ ID NO: 118757 - RNA, 1758 nt, Artificial Sequence; identical to SEQ ID NO: 118026
  derived and/or modified sequence opt2 from hemagglutinin__InfluenzaB__AGX18655

SEQ ID NO: 118758 - RNA, 1758 nt, Artificial Sequence; identical to SEQ ID NO: 118026
  derived and/or modified sequence opt2 from hemagglutinin__InfluenzaB__AGX18666

SEQ ID NO: 118759 - RNA, 1758 nt, Artificial Sequence; identical to SEQ ID NO: 118026
  derived and/or modified sequence opt2 from hemagglutinin__InfluenzaB__AGX18677

SEQ ID NO: 118760 - RNA, 1758 nt, Artificial Sequence; identical to SEQ ID NO: 118026
  derived and/or modified sequence opt2 from hemagglutinin__InfluenzaB__AGX18688

SEQ ID NO: 118761 - RNA, 1758 nt, Artificial Sequence; identical to SEQ ID NO: 118026
  derived and/or modified sequence opt2 from hemagglutinin__InfluenzaB__AGX18699

SEQ ID NO: 118762 - RNA, 1758 nt, Artificial Sequence; identical to SEQ ID NO: 118026
  derived and/or modified sequence opt2 from hemagglutinin__InfluenzaB__AGX18710

SEQ ID NO: 118763 - RNA, 1758 nt, Artificial Sequence; identical to SEQ ID NO: 118026
  derived and/or modified sequence opt2 from hemagglutinin__InfluenzaB__AGX18721

SEQ ID NO: 118764 - RNA, 1758 nt, Artificial Sequence; identical to SEQ ID NO: 118026
  derived and/or modified sequence opt2 from hemagglutinin__InfluenzaB__AGX18732

SEQ ID NO: 118765 - RNA, 1758 nt, Artificial Sequence
  derived and/or modified sequence opt2 from hemagglutinin__InfluenzaB__AGX18743
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccaaccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118766 - RNA, 1758 nt, Artificial Sequence; identical to SEQ ID NO: 118026
  derived and/or modified sequence opt2 from hemagglutinin__InfluenzaB__AGX18754

SEQ ID NO: 118767 - RNA, 1758 nt, Artificial Sequence; identical to SEQ ID NO: 118026
  derived and/or modified sequence opt2 from hemagglutinin__InfluenzaB__AGX18765

SEQ ID NO: 118768 - RNA, 1758 nt, Artificial Sequence; identical to SEQ ID NO: 118077
  derived and/or modified sequence opt2 from hemagglutinin__InfluenzaB__AGX18776

SEQ ID NO: 118769 - RNA, 1758 nt, Artificial Sequence; identical to SEQ ID NO: 118026
  derived and/or modified sequence opt2 from hemagglutinin__InfluenzaB__AGX18787

SEQ ID NO: 118770 - RNA, 1758 nt, Artificial Sequence; identical to SEQ ID NO: 118026
  derived and/or modified sequence opt2 from hemagglutinin__InfluenzaB__AGX18798

SEQ ID NO: 118771 - RNA, 1758 nt, Artificial Sequence
  derived and/or modified sequence opt2 from hemagglutinin__InfluenzaB__AGX18809
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugaugcagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118772 - RNA, 1758 nt, Artificial Sequence; identical to SEQ ID NO: 118689
  derived and/or modified sequence opt2 from hemagglutinin__InfluenzaB__AGX18820

SEQ ID NO: 118773 - RNA, 1758 nt, Artificial Sequence; identical to SEQ ID NO: 118026
  derived and/or modified sequence opt2 from hemagglutinin__InfluenzaB__AGX18831

SEQ ID NO: 118774 - RNA, 1758 nt, Artificial Sequence; identical to SEQ ID NO: 118026
  derived and/or modified sequence opt2 from hemagglutinin__InfluenzaB__AGX18842

SEQ ID NO: 118775 - RNA, 1758 nt, Artificial Sequence; identical to SEQ ID NO: 118094
  derived and/or modified sequence opt2 from hemagglutinin__InfluenzaB__AGX18853

SEQ ID NO: 118776 - RNA, 1758 nt, Artificial Sequence
  derived and/or modified sequence opt2 from hemagglutinin__InfluenzaB__AGX18864
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccaaccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118777 - RNA, 1758 nt, Artificial Sequence
  derived and/or modified sequence opt2 from hemagglutinin__InfluenzaB__AGX18875
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaaccgcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccaucgacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118778 - RNA, 1758 nt, Artificial Sequence
  derived and/or modified sequence opt2 from hemagglutinin__InfluenzaB__AGX18886
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacaacggccucgacaaccacaccauccuccucuacuacuccaccgccgccuccucccucgccgucacccucaucaucgccaucuucgucgucuacauggucucccgcgacaacgucuccugcuccaucugccucuga

SEQ ID NO: 118779 - RNA, 1758 nt, Artificial Sequence; identical to SEQ ID NO: 118499
  derived and/or modified sequence opt2 from hemagglutinin__InfluenzaB__AGX18897

SEQ ID NO: 118780 - RNA, 1758 nt, Artificial Sequence; identical to SEQ ID NO: 118026
  derived and/or modified sequence opt2 from hemagglutinin__InfluenzaB__AGX18908

SEQ ID NO: 118781 - RNA, 1758 nt, Artificial Sequence; identical to SEQ ID NO: 118026
  derived and/or modified sequence opt2 from hemagglutinin__InfluenzaB__AGX18919

SEQ ID NO: 118782 - RNA, 1758 nt, Artificial Sequence
  derived and/or modified sequence opt2 from hemagglutinin__InfluenzaB__AGX18930
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugcaucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118783 - RNA, 1758 nt, Artificial Sequence; identical to SEQ ID NO: 118026
  derived and/or modified sequence opt2 from hemagglutinin__InfluenzaB__AGX18941

SEQ ID NO: 118784 - RNA, 1758 nt, Artificial Sequence; identical to SEQ ID NO: 118026
  derived and/or modified sequence opt2 from hemagglutinin__InfluenzaB__AGX18952

SEQ ID NO: 118785 - RNA, 1758 nt, Artificial Sequence; identical to SEQ ID NO: 118026
  derived and/or modified sequence opt2 from hemagglutinin__InfluenzaB__AGX18963

SEQ ID NO: 118786 - RNA, 1758 nt, Artificial Sequence
  derived and/or modified sequence opt2 from hemagglutinin__InfluenzaB__AGX18974
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagaagaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118787 - RNA, 1758 nt, Artificial Sequence; identical to SEQ ID NO: 118026
  derived and/or modified sequence opt2 from hemagglutinin__InfluenzaB__AGX18985

SEQ ID NO: 118788 - RNA, 1758 nt, Artificial Sequence
  derived and/or modified sequence opt2 from hemagglutinin__InfluenzaB__AGX18996
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacacccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacggcacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118789 - RNA, 1758 nt, Artificial Sequence; identical to SEQ ID NO: 118026
  derived and/or modified sequence opt2 from hemagglutinin__InfluenzaB__AGX19007

SEQ ID NO: 118790 - RNA, 1758 nt, Artificial Sequence
  derived and/or modified sequence opt2 from hemagglutinin__InfluenzaB__AGX19018
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaacuuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118791 - RNA, 1758 nt, Artificial Sequence; identical to SEQ ID NO: 118689
  derived and/or modified sequence opt2 from hemagglutinin__InfluenzaB__AGX19029

SEQ ID NO: 118792 - RNA, 1758 nt, Artificial Sequence; identical to SEQ ID NO: 118026
  derived and/or modified sequence opt2 from hemagglutinin__InfluenzaB__AGX19040

SEQ ID NO: 118793 - RNA, 1758 nt, Artificial Sequence
  derived and/or modified sequence opt2 from hemagglutinin__InfluenzaB__AGX19051
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacaccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118794 - RNA, 1758 nt, Artificial Sequence
  derived and/or modified sequence opt2 from hemagglutinin__InfluenzaB__AGX19062
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaacuucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118795 - RNA, 1758 nt, Artificial Sequence; identical to SEQ ID NO: 118026
  derived and/or modified sequence opt2 from hemagglutinin__InfluenzaB__AGX19073

SEQ ID NO: 118796 - RNA, 1758 nt, Artificial Sequence
  derived and/or modified sequence opt2 from hemagglutinin__InfluenzaB__AGX19084
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacaucaagcucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagaaccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118797 - RNA, 1758 nt, Artificial Sequence; identical to SEQ ID NO: 118026
  derived and/or modified sequence opt2 from hemagglutinin__InfluenzaB__AGX19095

SEQ ID NO: 118798 - RNA, 1758 nt, Artificial Sequence; identical to SEQ ID NO: 118689
  derived and/or modified sequence opt2 from hemagglutinin__InfluenzaB__AGX19106

SEQ ID NO: 118799 - RNA, 1758 nt, Artificial Sequence; identical to SEQ ID NO: 118026
  derived and/or modified sequence opt2 from hemagglutinin__InfluenzaB__AGX19117

SEQ ID NO: 118800 - RNA, 1758 nt, Artificial Sequence
  derived and/or modified sequence opt2 from hemagglutinin__InfluenzaB__AGX19128
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacacccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118801 - RNA, 1758 nt, Artificial Sequence; identical to SEQ ID NO: 118026
  derived and/or modified sequence opt2 from hemagglutinin__InfluenzaB__AGX19139

SEQ ID NO: 118802 - RNA, 1758 nt, Artificial Sequence; identical to SEQ ID NO: 118499
  derived and/or modified sequence opt2 from hemagglutinin__InfluenzaB__AGX19150

SEQ ID NO: 118803 - RNA, 1758 nt, Artificial Sequence; identical to SEQ ID NO: 118026
  derived and/or modified sequence opt2 from hemagglutinin__InfluenzaB__AGX19161

SEQ ID NO: 118804 - RNA, 1758 nt, Artificial Sequence; identical to SEQ ID NO: 118499
  derived and/or modified sequence opt2 from hemagglutinin__InfluenzaB__AGX19172

SEQ ID NO: 118805 - RNA, 1758 nt, Artificial Sequence
  derived and/or modified sequence opt2 from hemagglutinin__InfluenzaB__AGX19183
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118806 - RNA, 1758 nt, Artificial Sequence; identical to SEQ ID NO: 118026
  derived and/or modified sequence opt2 from hemagglutinin__InfluenzaB__AGX19194

SEQ ID NO: 118807 - RNA, 1758 nt, Artificial Sequence
  derived and/or modified sequence opt2 from hemagglutinin__InfluenzaB__AGX19205
augaaggccaucaucguccuccucauggucgucaccuccaacgccgaccgcgucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118808 - RNA, 1758 nt, Artificial Sequence
  derived and/or modified sequence opt2 from hemagglutinin__InfluenzaB__AGX19216
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagcccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118809 - RNA, 1758 nt, Artificial Sequence
  derived and/or modified sequence opt2 from hemagglutinin__InfluenzaB__AGX19227
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugcccccagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaaguccgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118810 - RNA, 1758 nt, Artificial Sequence
  derived and/or modified sequence opt2 from hemagglutinin__InfluenzaB__AGX19238
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118811 - RNA, 1758 nt, Artificial Sequence; identical to SEQ ID NO: 118810
  derived and/or modified sequence opt2 from hemagglutinin__InfluenzaB__AGX19249

SEQ ID NO: 118812 - RNA, 1758 nt, Artificial Sequence; identical to SEQ ID NO: 118026
  derived and/or modified sequence opt2 from hemagglutinin__InfluenzaB__AGX19260

SEQ ID NO: 118813 - RNA, 1758 nt, Artificial Sequence; identical to SEQ ID NO: 118026
  derived and/or modified sequence opt2 from hemagglutinin__InfluenzaB__AGX19271

SEQ ID NO: 118814 - RNA, 1758 nt, Artificial Sequence
  derived and/or modified sequence opt2 from hemagglutinin__InfluenzaB__AGX19282
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118815 - RNA, 1758 nt, Artificial Sequence
  derived and/or modified sequence opt2 from hemagglutinin__InfluenzaB__AGX19304
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaucaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118816 - RNA, 1758 nt, Artificial Sequence; identical to SEQ ID NO: 118815
  derived and/or modified sequence opt2 from hemagglutinin__InfluenzaB__AGX19315

SEQ ID NO: 118817 - RNA, 1758 nt, Artificial Sequence; identical to SEQ ID NO: 118814
  derived and/or modified sequence opt2 from hemagglutinin__InfluenzaB__AGX19326

SEQ ID NO: 118818 - RNA, 1758 nt, Artificial Sequence; identical to SEQ ID NO: 118814
  derived and/or modified sequence opt2 from hemagglutinin__InfluenzaB__AGX19337

SEQ ID NO: 118819 - RNA, 1758 nt, Artificial Sequence
  derived and/or modified sequence opt2 from hemagglutinin__InfluenzaB__AGX19348
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118820 - RNA, 1758 nt, Artificial Sequence; identical to SEQ ID NO: 118814
  derived and/or modified sequence opt2 from hemagglutinin__InfluenzaB__AGX19359

SEQ ID NO: 118821 - RNA, 1755 nt, Artificial Sequence; identical to SEQ ID NO: 118243
  derived and/or modified sequence opt2 from hemagglutinin__InfluenzaB__AGX19370

SEQ ID NO: 118822 - RNA, 1758 nt, Artificial Sequence; identical to SEQ ID NO: 118077
  derived and/or modified sequence opt2 from hemagglutinin__InfluenzaB__AGX19381

SEQ ID NO: 118823 - RNA, 1758 nt, Artificial Sequence; identical to SEQ ID NO: 118814
  derived and/or modified sequence opt2 from hemagglutinin__InfluenzaB__AGX19392

SEQ ID NO: 118824 - RNA, 1758 nt, Artificial Sequence; identical to SEQ ID NO: 118814
  derived and/or modified sequence opt2 from hemagglutinin__InfluenzaB__AGX19403

SEQ ID NO: 118825 - RNA, 1758 nt, Artificial Sequence; identical to SEQ ID NO: 118501
  derived and/or modified sequence opt2 from hemagglutinin__InfluenzaB__AGX19414

SEQ ID NO: 118826 - RNA, 1755 nt, Artificial Sequence
  derived and/or modified sequence opt2 from hemagglutinin__InfluenzaB__AGX19425
augaagaccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugcgcaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcgcccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 118827 - RNA, 1758 nt, Artificial Sequence; identical to SEQ ID NO: 118026
  derived and/or modified sequence opt2 from hemagglutinin__InfluenzaB__AGX19436

SEQ ID NO: 118828 - RNA, 1758 nt, Artificial Sequence; identical to SEQ ID NO: 118689
  derived and/or modified sequence opt2 from hemagglutinin__InfluenzaB__AGX19447

SEQ ID NO: 118829 - RNA, 1755 nt, Artificial Sequence; identical to SEQ ID NO: 118568
  derived and/or modified sequence opt2 from hemagglutinin__InfluenzaB__AGX19458

SEQ ID NO: 118830 - RNA, 1755 nt, Artificial Sequence; identical to SEQ ID NO: 118568
  derived and/or modified sequence opt2 from hemagglutinin__InfluenzaB__AGX19469

SEQ ID NO: 118831 - RNA, 1758 nt, Artificial Sequence; identical to SEQ ID NO: 118501
  derived and/or modified sequence opt2 from hemagglutinin__InfluenzaB__AGX19480

SEQ ID NO: 118832 - RNA, 1758 nt, Artificial Sequence; identical to SEQ ID NO: 118094
  derived and/or modified sequence opt2 from hemagglutinin__InfluenzaB__AGX19491

SEQ ID NO: 118833 - RNA, 1758 nt, Artificial Sequence
  derived and/or modified sequence opt2 from hemagglutinin__InfluenzaB__AGX19502
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118834 - RNA, 1758 nt, Artificial Sequence
  derived and/or modified sequence opt2 from hemagglutinin__InfluenzaB__AGX19513
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacaucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118835 - RNA, 1758 nt, Artificial Sequence; identical to SEQ ID NO: 118834
  derived and/or modified sequence opt2 from hemagglutinin__InfluenzaB__AGX19524

SEQ ID NO: 118836 - RNA, 1758 nt, Artificial Sequence
  derived and/or modified sequence opt2 from hemagglutinin__InfluenzaB__AGX19535
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118837 - RNA, 1758 nt, Artificial Sequence
  derived and/or modified sequence opt2 from hemagglutinin__InfluenzaB__AGX19546
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaaggagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118838 - RNA, 1758 nt, Artificial Sequence
  derived and/or modified sequence opt2 from hemagglutinin__InfluenzaB__AGX19557
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccggcggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118839 - RNA, 1758 nt, Artificial Sequence; identical to SEQ ID NO: 118501
  derived and/or modified sequence opt2 from hemagglutinin__InfluenzaB__AGX19568

SEQ ID NO: 118840 - RNA, 1758 nt, Artificial Sequence; identical to SEQ ID NO: 118834
  derived and/or modified sequence opt2 from hemagglutinin__InfluenzaB__AGX19579

SEQ ID NO: 118841 - RNA, 1758 nt, Artificial Sequence; identical to SEQ ID NO: 118501
  derived and/or modified sequence opt2 from hemagglutinin__InfluenzaB__AGX19590

SEQ ID NO: 118842 - RNA, 1758 nt, Artificial Sequence; identical to SEQ ID NO: 118501
  derived and/or modified sequence opt2 from hemagglutinin__InfluenzaB__AGX19601

SEQ ID NO: 118843 - RNA, 1758 nt, Artificial Sequence; identical to SEQ ID NO: 118501
  derived and/or modified sequence opt2 from hemagglutinin__InfluenzaB__AGX19612

SEQ ID NO: 118844 - RNA, 1758 nt, Artificial Sequence
  derived and/or modified sequence opt2 from hemagglutinin__InfluenzaB__AGX19623
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucgcccucaugaucgccaucuucgucgucuacauggucucccgcgacaacgucuccugcuccaucugccucuga

SEQ ID NO: 118845 - RNA, 1758 nt, Artificial Sequence; identical to SEQ ID NO: 118501
  derived and/or modified sequence opt2 from hemagglutinin__InfluenzaB__AGX19634

SEQ ID NO: 118846 - RNA, 1758 nt, Artificial Sequence; identical to SEQ ID NO: 118026
  derived and/or modified sequence opt2 from hemagglutinin__InfluenzaB__AGX19645

SEQ ID NO: 118847 - RNA, 1758 nt, Artificial Sequence; identical to SEQ ID NO: 118077
  derived and/or modified sequence opt2 from hemagglutinin__InfluenzaB__AGX19656

SEQ ID NO: 118848 - RNA, 1758 nt, Artificial Sequence
  derived and/or modified sequence opt2 from hemagglutinin__InfluenzaB__AGX19667
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaaggaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118849 - RNA, 1758 nt, Artificial Sequence; identical to SEQ ID NO: 118501
  derived and/or modified sequence opt2 from hemagglutinin__InfluenzaB__AGX19678

SEQ ID NO: 118850 - RNA, 1758 nt, Artificial Sequence; identical to SEQ ID NO: 118026
  derived and/or modified sequence opt2 from hemagglutinin__InfluenzaB__AGX19700

SEQ ID NO: 118851 - RNA, 1758 nt, Artificial Sequence
  derived and/or modified sequence opt2 from hemagglutinin__InfluenzaB__AGX19711
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacucccucaccaucgagguccccuacaucugcaaggagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118852 - RNA, 1758 nt, Artificial Sequence; identical to SEQ ID NO: 118501
  derived and/or modified sequence opt2 from hemagglutinin__InfluenzaB__AGX19722

SEQ ID NO: 118853 - RNA, 1758 nt, Artificial Sequence; identical to SEQ ID NO: 118501
  derived and/or modified sequence opt2 from hemagglutinin__InfluenzaB__AGX19733

SEQ ID NO: 118854 - RNA, 1758 nt, Artificial Sequence; identical to SEQ ID NO: 118501
  derived and/or modified sequence opt2 from hemagglutinin__InfluenzaB__AGX19744

SEQ ID NO: 118855 - RNA, 1758 nt, Artificial Sequence; identical to SEQ ID NO: 118026
  derived and/or modified sequence opt2 from hemagglutinin__InfluenzaB__AGX19755

SEQ ID NO: 118856 - RNA, 1758 nt, Artificial Sequence; identical to SEQ ID NO: 118501
  derived and/or modified sequence opt2 from hemagglutinin__InfluenzaB__AGX19766

SEQ ID NO: 118857 - RNA, 1758 nt, Artificial Sequence; identical to SEQ ID NO: 118834
  derived and/or modified sequence opt2 from hemagglutinin__InfluenzaB__AGX19788

SEQ ID NO: 118858 - RNA, 1758 nt, Artificial Sequence; identical to SEQ ID NO: 118501
  derived and/or modified sequence opt2 from hemagglutinin__InfluenzaB__AGX19799

SEQ ID NO: 118859 - RNA, 1758 nt, Artificial Sequence; identical to SEQ ID NO: 118501
  derived and/or modified sequence opt2 from hemagglutinin__InfluenzaB__AGX19810

SEQ ID NO: 118860 - RNA, 1758 nt, Artificial Sequence
  derived and/or modified sequence opt2 from hemagglutinin__InfluenzaB__AGX19821
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcuccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118861 - RNA, 1758 nt, Artificial Sequence; identical to SEQ ID NO: 118834
  derived and/or modified sequence opt2 from hemagglutinin__InfluenzaB__AGX19832

SEQ ID NO: 118862 - RNA, 1758 nt, Artificial Sequence; identical to SEQ ID NO: 118501
  derived and/or modified sequence opt2 from hemagglutinin__InfluenzaB__AGX19843

SEQ ID NO: 118863 - RNA, 1758 nt, Artificial Sequence; identical to SEQ ID NO: 118501
  derived and/or modified sequence opt2 from hemagglutinin__InfluenzaB__AGX19854

SEQ ID NO: 118864 - RNA, 1758 nt, Artificial Sequence; identical to SEQ ID NO: 118501
  derived and/or modified sequence opt2 from hemagglutinin__InfluenzaB__AGX19865

SEQ ID NO: 118865 - RNA, 1758 nt, Artificial Sequence; identical to SEQ ID NO: 118834
  derived and/or modified sequence opt2 from hemagglutinin__InfluenzaB__AGX19876

SEQ ID NO: 118866 - RNA, 1758 nt, Artificial Sequence; identical to SEQ ID NO: 118501
  derived and/or modified sequence opt2 from hemagglutinin__InfluenzaB__AGX19887

SEQ ID NO: 118867 - RNA, 1758 nt, Artificial Sequence
  derived and/or modified sequence opt2 from hemagglutinin__InfluenzaB__AGX19898
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacgagaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118868 - RNA, 1758 nt, Artificial Sequence; identical to SEQ ID NO: 118026
  derived and/or modified sequence opt2 from hemagglutinin__InfluenzaB__AGX19909

SEQ ID NO: 118869 - RNA, 1758 nt, Artificial Sequence; identical to SEQ ID NO: 118501
  derived and/or modified sequence opt2 from hemagglutinin__InfluenzaB__AGX19920

SEQ ID NO: 118870 - RNA, 1758 nt, Artificial Sequence; identical to SEQ ID NO: 118867
  derived and/or modified sequence opt2 from hemagglutinin__InfluenzaB__AGX19931

SEQ ID NO: 118871 - RNA, 1758 nt, Artificial Sequence; identical to SEQ ID NO: 118834
  derived and/or modified sequence opt2 from hemagglutinin__InfluenzaB__AGX19942

SEQ ID NO: 118872 - RNA, 1758 nt, Artificial Sequence; identical to SEQ ID NO: 118501
  derived and/or modified sequence opt2 from hemagglutinin__InfluenzaB__AGX19953

SEQ ID NO: 118873 - RNA, 1758 nt, Artificial Sequence; identical to SEQ ID NO: 118259
  derived and/or modified sequence opt2 from hemagglutinin__InfluenzaB__AGX19964

SEQ ID NO: 118874 - RNA, 1758 nt, Artificial Sequence; identical to SEQ ID NO: 118026
  derived and/or modified sequence opt2 from hemagglutinin__InfluenzaB__AGX19975

SEQ ID NO: 118875 - RNA, 1758 nt, Artificial Sequence
  derived and/or modified sequence opt2 from hemagglutinin__InfluenzaB__AGX19986
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgucuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118876 - RNA, 1758 nt, Artificial Sequence
  derived and/or modified sequence opt2 from hemagglutinin__InfluenzaB__AGX19997
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaucgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118877 - RNA, 1758 nt, Artificial Sequence; identical to SEQ ID NO: 118501
  derived and/or modified sequence opt2 from hemagglutinin__InfluenzaB__AGX20008

SEQ ID NO: 118878 - RNA, 1758 nt, Artificial Sequence; identical to SEQ ID NO: 118501
  derived and/or modified sequence opt2 from hemagglutinin__InfluenzaB__AGX20019

SEQ ID NO: 118879 - RNA, 1758 nt, Artificial Sequence; identical to SEQ ID NO: 118501
  derived and/or modified sequence opt2 from hemagglutinin__InfluenzaB__AGX20030

SEQ ID NO: 118880 - RNA, 1758 nt, Artificial Sequence
  derived and/or modified sequence opt2 from hemagglutinin__InfluenzaB__AGX20041
augaaggccaucaucguccuccucauggucgucaccuccgacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaaggagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118881 - RNA, 1758 nt, Artificial Sequence; identical to SEQ ID NO: 118501
  derived and/or modified sequence opt2 from hemagglutinin__InfluenzaB__AGX20052

SEQ ID NO: 118882 - RNA, 1758 nt, Artificial Sequence; identical to SEQ ID NO: 118501
  derived and/or modified sequence opt2 from hemagglutinin__InfluenzaB__AGX20063

SEQ ID NO: 118883 - RNA, 1758 nt, Artificial Sequence
  derived and/or modified sequence opt2 from hemagglutinin__InfluenzaB__AGX20074
augaaggccaucaucgcccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118884 - RNA, 1758 nt, Artificial Sequence
  derived and/or modified sequence opt2 from hemagglutinin__InfluenzaB__AGX20085
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118885 - RNA, 1758 nt, Artificial Sequence
  derived and/or modified sequence opt2 from hemagglutinin__InfluenzaB__AGX20096
augaaggccaucaucguccuccucauggucgucaccuccaacgccgaccgcaucugcaccggcgucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118886 - RNA, 1758 nt, Artificial Sequence; identical to SEQ ID NO: 118120
  derived and/or modified sequence opt2 from hemagglutinin__InfluenzaB__AGX20107

SEQ ID NO: 118887 - RNA, 1758 nt, Artificial Sequence; identical to SEQ ID NO: 118120
  derived and/or modified sequence opt2 from hemagglutinin__InfluenzaB__AGX20118

SEQ ID NO: 118888 - RNA, 1758 nt, Artificial Sequence; identical to SEQ ID NO: 118120
  derived and/or modified sequence opt2 from hemagglutinin__InfluenzaB__AGX20129

SEQ ID NO: 118889 - RNA, 1758 nt, Artificial Sequence; identical to SEQ ID NO: 118120
  derived and/or modified sequence opt2 from hemagglutinin__InfluenzaB__AGX20140

SEQ ID NO: 118890 - RNA, 1758 nt, Artificial Sequence; identical to SEQ ID NO: 118120
  derived and/or modified sequence opt2 from hemagglutinin__InfluenzaB__AGX20151

SEQ ID NO: 118891 - RNA, 1758 nt, Artificial Sequence; identical to SEQ ID NO: 118120
  derived and/or modified sequence opt2 from hemagglutinin__InfluenzaB__AGX20162

SEQ ID NO: 118892 - RNA, 1758 nt, Artificial Sequence; identical to SEQ ID NO: 118120
  derived and/or modified sequence opt2 from hemagglutinin__InfluenzaB__AGX20173

SEQ ID NO: 118893 - RNA, 1758 nt, Artificial Sequence; identical to SEQ ID NO: 118120
  derived and/or modified sequence opt2 from hemagglutinin__InfluenzaB__AGX20184

SEQ ID NO: 118894 - RNA, 1758 nt, Artificial Sequence; identical to SEQ ID NO: 118120
  derived and/or modified sequence opt2 from hemagglutinin__InfluenzaB__AGX20195

SEQ ID NO: 118895 - RNA, 1758 nt, Artificial Sequence; identical to SEQ ID NO: 118120
  derived and/or modified sequence opt2 from hemagglutinin__InfluenzaB__AGX20206

SEQ ID NO: 118896 - RNA, 1758 nt, Artificial Sequence; identical to SEQ ID NO: 118120
  derived and/or modified sequence opt2 from hemagglutinin__InfluenzaB__AGX20217

SEQ ID NO: 118897 - RNA, 1758 nt, Artificial Sequence; identical to SEQ ID NO: 118157
  derived and/or modified sequence opt2 from hemagglutinin__InfluenzaB__AGX20228

SEQ ID NO: 118898 - RNA, 1758 nt, Artificial Sequence
  derived and/or modified sequence opt2 from hemagglutinin__InfluenzaB__AGX20239
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaucgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118899 - RNA, 1758 nt, Artificial Sequence; identical to SEQ ID NO: 118120
  derived and/or modified sequence opt2 from hemagglutinin__InfluenzaB__AGX20250

SEQ ID NO: 118900 - RNA, 1758 nt, Artificial Sequence; identical to SEQ ID NO: 118120
  derived and/or modified sequence opt2 from hemagglutinin__InfluenzaB__AGX20261

SEQ ID NO: 118901 - RNA, 1758 nt, Artificial Sequence; identical to SEQ ID NO: 118120
  derived and/or modified sequence opt2 from hemagglutinin__InfluenzaB__AGX20272

SEQ ID NO: 118902 - RNA, 1758 nt, Artificial Sequence; identical to SEQ ID NO: 118120
  derived and/or modified sequence opt2 from hemagglutinin__InfluenzaB__AGX20283

SEQ ID NO: 118903 - RNA, 1758 nt, Artificial Sequence; identical to SEQ ID NO: 118120
  derived and/or modified sequence opt2 from hemagglutinin__InfluenzaB__AGX20294

SEQ ID NO: 118904 - RNA, 1758 nt, Artificial Sequence
  derived and/or modified sequence opt2 from hemagglutinin__InfluenzaB__AGX20305
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaaccagcucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118905 - RNA, 1758 nt, Artificial Sequence; identical to SEQ ID NO: 118120
  derived and/or modified sequence opt2 from hemagglutinin__InfluenzaB__AGX20316

SEQ ID NO: 118906 - RNA, 1758 nt, Artificial Sequence; identical to SEQ ID NO: 118120
  derived and/or modified sequence opt2 from hemagglutinin__InfluenzaB__AGX20327

SEQ ID NO: 118907 - RNA, 1758 nt, Artificial Sequence
  derived and/or modified sequence opt2 from hemagglutinin__InfluenzaB__AGX20338
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaaccucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118908 - RNA, 1758 nt, Artificial Sequence; identical to SEQ ID NO: 118120
  derived and/or modified sequence opt2 from hemagglutinin__InfluenzaB__AGX20349

SEQ ID NO: 118909 - RNA, 1758 nt, Artificial Sequence; identical to SEQ ID NO: 118120
  derived and/or modified sequence opt2 from hemagglutinin__InfluenzaB__AGX20360

SEQ ID NO: 118910 - RNA, 1758 nt, Artificial Sequence; identical to SEQ ID NO: 118157
  derived and/or modified sequence opt2 from hemagglutinin__InfluenzaB__AGX20371

SEQ ID NO: 118911 - RNA, 1758 nt, Artificial Sequence
  derived and/or modified sequence opt2 from hemagglutinin__InfluenzaB__AGX20382
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccaugaacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118912 - RNA, 1758 nt, Artificial Sequence; identical to SEQ ID NO: 118120
  derived and/or modified sequence opt2 from hemagglutinin__InfluenzaB__AGX20393

SEQ ID NO: 118913 - RNA, 1758 nt, Artificial Sequence; identical to SEQ ID NO: 118157
  derived and/or modified sequence opt2 from hemagglutinin__InfluenzaB__AGX20404

SEQ ID NO: 118914 - RNA, 1758 nt, Artificial Sequence; identical to SEQ ID NO: 118120
  derived and/or modified sequence opt2 from hemagglutinin__InfluenzaB__AGX20415

SEQ ID NO: 118915 - RNA, 1758 nt, Artificial Sequence; identical to SEQ ID NO: 118120
  derived and/or modified sequence opt2 from hemagglutinin__InfluenzaB__AGX20426

SEQ ID NO: 118916 - RNA, 1758 nt, Artificial Sequence; identical to SEQ ID NO: 118120
  derived and/or modified sequence opt2 from hemagglutinin__InfluenzaB__AGX20437

SEQ ID NO: 118917 - RNA, 1758 nt, Artificial Sequence; identical to SEQ ID NO: 118120
  derived and/or modified sequence opt2 from hemagglutinin__InfluenzaB__AGX20448

SEQ ID NO: 118918 - RNA, 1758 nt, Artificial Sequence; identical to SEQ ID NO: 118120
  derived and/or modified sequence opt2 from hemagglutinin__InfluenzaB__AGX20459

SEQ ID NO: 118919 - RNA, 1758 nt, Artificial Sequence; identical to SEQ ID NO: 118120
  derived and/or modified sequence opt2 from hemagglutinin__InfluenzaB__AGX20470

SEQ ID NO: 118920 - RNA, 1758 nt, Artificial Sequence; identical to SEQ ID NO: 118120
  derived and/or modified sequence opt2 from hemagglutinin__InfluenzaB__AGX20481

SEQ ID NO: 118921 - RNA, 1758 nt, Artificial Sequence; identical to SEQ ID NO: 118120
  derived and/or modified sequence opt2 from hemagglutinin__InfluenzaB__AGX20492

SEQ ID NO: 118922 - RNA, 1758 nt, Artificial Sequence; identical to SEQ ID NO: 118120
  derived and/or modified sequence opt2 from hemagglutinin__InfluenzaB__AGX20503

SEQ ID NO: 118923 - RNA, 1758 nt, Artificial Sequence; identical to SEQ ID NO: 118120
  derived and/or modified sequence opt2 from hemagglutinin__InfluenzaB__AGX20514

SEQ ID NO: 118924 - RNA, 1758 nt, Artificial Sequence
  derived and/or modified sequence opt2 from hemagglutinin__InfluenzaB__AGX20525
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucuccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118925 - RNA, 1758 nt, Artificial Sequence; identical to SEQ ID NO: 118120
  derived and/or modified sequence opt2 from hemagglutinin__InfluenzaB__AGX20536

SEQ ID NO: 118926 - RNA, 1758 nt, Artificial Sequence
  derived and/or modified sequence opt2 from hemagglutinin__InfluenzaB__AGX20547
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccaccacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgagaucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118927 - RNA, 1758 nt, Artificial Sequence; identical to SEQ ID NO: 118174
  derived and/or modified sequence opt2 from hemagglutinin__InfluenzaB__AGX20558

SEQ ID NO: 118928 - RNA, 1758 nt, Artificial Sequence; identical to SEQ ID NO: 118120
  derived and/or modified sequence opt2 from hemagglutinin__InfluenzaB__AGX20569

SEQ ID NO: 118929 - RNA, 1758 nt, Artificial Sequence; identical to SEQ ID NO: 118157
  derived and/or modified sequence opt2 from hemagglutinin__InfluenzaB__AGX20580

SEQ ID NO: 118930 - RNA, 1758 nt, Artificial Sequence; identical to SEQ ID NO: 118120
  derived and/or modified sequence opt2 from hemagglutinin__InfluenzaB__AGX20591

SEQ ID NO: 118931 - RNA, 1758 nt, Artificial Sequence; identical to SEQ ID NO: 118120
  derived and/or modified sequence opt2 from hemagglutinin__InfluenzaB__AGX20602

SEQ ID NO: 118932 - RNA, 1758 nt, Artificial Sequence; identical to SEQ ID NO: 118120
  derived and/or modified sequence opt2 from hemagglutinin__InfluenzaB__AGX20613

SEQ ID NO: 118933 - RNA, 1758 nt, Artificial Sequence; identical to SEQ ID NO: 118120
  derived and/or modified sequence opt2 from hemagglutinin__InfluenzaB__AGX20624

SEQ ID NO: 118934 - RNA, 1758 nt, Artificial Sequence
  derived and/or modified sequence opt2 from hemagglutinin__InfluenzaB__AGX20635
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccucauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118935 - RNA, 1758 nt, Artificial Sequence; identical to SEQ ID NO: 118120
  derived and/or modified sequence opt2 from hemagglutinin__InfluenzaB__AGX20646

SEQ ID NO: 118936 - RNA, 1758 nt, Artificial Sequence
  derived and/or modified sequence opt2 from hemagglutinin__InfluenzaB__AGX20668
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaccaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118937 - RNA, 1758 nt, Artificial Sequence; identical to SEQ ID NO: 118195
  derived and/or modified sequence opt2 from hemagglutinin__InfluenzaB__AGX20679

SEQ ID NO: 118938 - RNA, 1758 nt, Artificial Sequence; identical to SEQ ID NO: 118157
  derived and/or modified sequence opt2 from hemagglutinin__InfluenzaB__AGX20690

SEQ ID NO: 118939 - RNA, 1758 nt, Artificial Sequence; identical to SEQ ID NO: 118157
  derived and/or modified sequence opt2 from hemagglutinin__InfluenzaB__AGX20701

SEQ ID NO: 118940 - RNA, 1758 nt, Artificial Sequence; identical to SEQ ID NO: 118501
  derived and/or modified sequence opt2 from hemagglutinin__InfluenzaB__AGX20712

SEQ ID NO: 118941 - RNA, 1758 nt, Artificial Sequence; identical to SEQ ID NO: 118120
  derived and/or modified sequence opt2 from hemagglutinin__InfluenzaB__AGX20723

SEQ ID NO: 118942 - RNA, 1758 nt, Artificial Sequence
  derived and/or modified sequence opt2 from hemagglutinin__InfluenzaB__AGX20734
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccaccaacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118943 - RNA, 1758 nt, Artificial Sequence
  derived and/or modified sequence opt2 from hemagglutinin__InfluenzaB__AGX20745
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118944 - RNA, 1758 nt, Artificial Sequence; identical to SEQ ID NO: 118501
  derived and/or modified sequence opt2 from hemagglutinin__InfluenzaB__AGX20756

SEQ ID NO: 118945 - RNA, 1758 nt, Artificial Sequence; identical to SEQ ID NO: 118120
  derived and/or modified sequence opt2 from hemagglutinin__InfluenzaB__AGX20767

SEQ ID NO: 118946 - RNA, 1758 nt, Artificial Sequence; identical to SEQ ID NO: 118157
  derived and/or modified sequence opt2 from hemagglutinin__InfluenzaB__AGX20778

SEQ ID NO: 118947 - RNA, 1758 nt, Artificial Sequence
  derived and/or modified sequence opt2 from hemagglutinin__InfluenzaB__AGX20789
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacggcgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118948 - RNA, 1758 nt, Artificial Sequence
  derived and/or modified sequence opt2 from hemagglutinin__InfluenzaB__AGX20800
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacgagcucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118949 - RNA, 1758 nt, Artificial Sequence; identical to SEQ ID NO: 118195
  derived and/or modified sequence opt2 from hemagglutinin__InfluenzaB__AGX20811

SEQ ID NO: 118950 - RNA, 1758 nt, Artificial Sequence; identical to SEQ ID NO: 118195
  derived and/or modified sequence opt2 from hemagglutinin__InfluenzaB__AGX20822

SEQ ID NO: 118951 - RNA, 1758 nt, Artificial Sequence; identical to SEQ ID NO: 118195
  derived and/or modified sequence opt2 from hemagglutinin__InfluenzaB__AGX20833

SEQ ID NO: 118952 - RNA, 1758 nt, Artificial Sequence
  derived and/or modified sequence opt2 from hemagglutinin__InfluenzaB__AGX20844
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaugggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118953 - RNA, 1758 nt, Artificial Sequence; identical to SEQ ID NO: 118120
  derived and/or modified sequence opt2 from hemagglutinin__InfluenzaB__AGX20855

SEQ ID NO: 118954 - RNA, 1758 nt, Artificial Sequence; identical to SEQ ID NO: 118195
  derived and/or modified sequence opt2 from hemagglutinin__InfluenzaB__AGX20866

SEQ ID NO: 118955 - RNA, 1758 nt, Artificial Sequence; identical to SEQ ID NO: 118195
  derived and/or modified sequence opt2 from hemagglutinin__InfluenzaB__AGX20877

SEQ ID NO: 118956 - RNA, 1758 nt, Artificial Sequence
  derived and/or modified sequence opt2 from hemagglutinin__InfluenzaB__AGX20888
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118957 - RNA, 1758 nt, Artificial Sequence; identical to SEQ ID NO: 118195
  derived and/or modified sequence opt2 from hemagglutinin__InfluenzaB__AGX20899

SEQ ID NO: 118958 - RNA, 1758 nt, Artificial Sequence; identical to SEQ ID NO: 118195
  derived and/or modified sequence opt2 from hemagglutinin__InfluenzaB__AGX20910

SEQ ID NO: 118959 - RNA, 1758 nt, Artificial Sequence; identical to SEQ ID NO: 118120
  derived and/or modified sequence opt2 from hemagglutinin__InfluenzaB__AGX20921

SEQ ID NO: 118960 - RNA, 1758 nt, Artificial Sequence
  derived and/or modified sequence opt2 from hemagglutinin__InfluenzaB__AGX20932
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgaccccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118961 - RNA, 1758 nt, Artificial Sequence; identical to SEQ ID NO: 118120
  derived and/or modified sequence opt2 from hemagglutinin__InfluenzaB__AGX20943

SEQ ID NO: 118962 - RNA, 1758 nt, Artificial Sequence; identical to SEQ ID NO: 118120
  derived and/or modified sequence opt2 from hemagglutinin__InfluenzaB__AGX20954

SEQ ID NO: 118963 - RNA, 1758 nt, Artificial Sequence; identical to SEQ ID NO: 118120
  derived and/or modified sequence opt2 from hemagglutinin__InfluenzaB__AGX20965

SEQ ID NO: 118964 - RNA, 1758 nt, Artificial Sequence
  derived and/or modified sequence opt2 from hemagglutinin__InfluenzaB__AGX20976
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacggcgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118965 - RNA, 1758 nt, Artificial Sequence; identical to SEQ ID NO: 118120
  derived and/or modified sequence opt2 from hemagglutinin__InfluenzaB__AGX20987

SEQ ID NO: 118966 - RNA, 1758 nt, Artificial Sequence; identical to SEQ ID NO: 118195
  derived and/or modified sequence opt2 from hemagglutinin__InfluenzaB__AGX20998

SEQ ID NO: 118967 - RNA, 1758 nt, Artificial Sequence
  derived and/or modified sequence opt2 from hemagglutinin__InfluenzaB__AGX21009
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacaugaucucccgcgacaacgucuccugcuccaucugccucuga

SEQ ID NO: 118968 - RNA, 1758 nt, Artificial Sequence
  derived and/or modified sequence opt2 from hemagglutinin__InfluenzaB__AGX21020
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccgagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118969 - RNA, 1758 nt, Artificial Sequence; identical to SEQ ID NO: 118195
  derived and/or modified sequence opt2 from hemagglutinin__InfluenzaB__AGX21031

SEQ ID NO: 118970 - RNA, 1758 nt, Artificial Sequence
  derived and/or modified sequence opt2 from hemagglutinin__InfluenzaB__AGX21042
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacaccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118971 - RNA, 1758 nt, Artificial Sequence; identical to SEQ ID NO: 118157
  derived and/or modified sequence opt2 from hemagglutinin__InfluenzaB__AGX21053

SEQ ID NO: 118972 - RNA, 1758 nt, Artificial Sequence; identical to SEQ ID NO: 118120
  derived and/or modified sequence opt2 from hemagglutinin__InfluenzaB__AGX21064

SEQ ID NO: 118973 - RNA, 1758 nt, Artificial Sequence; identical to SEQ ID NO: 118157
  derived and/or modified sequence opt2 from hemagglutinin__InfluenzaB__AGX21075

SEQ ID NO: 118974 - RNA, 1758 nt, Artificial Sequence; identical to SEQ ID NO: 118157
  derived and/or modified sequence opt2 from hemagglutinin__InfluenzaB__AGX21084

SEQ ID NO: 118975 - RNA, 1758 nt, Artificial Sequence; identical to SEQ ID NO: 118157
  derived and/or modified sequence opt2 from hemagglutinin__InfluenzaB__AGX21095

SEQ ID NO: 118976 - RNA, 1758 nt, Artificial Sequence
  derived and/or modified sequence opt2 from hemagglutinin__InfluenzaB__AGX21106
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118977 - RNA, 1758 nt, Artificial Sequence; identical to SEQ ID NO: 118120
  derived and/or modified sequence opt2 from hemagglutinin__InfluenzaB__AGX21117

SEQ ID NO: 118978 - RNA, 1758 nt, Artificial Sequence; identical to SEQ ID NO: 118970
  derived and/or modified sequence opt2 from hemagglutinin__InfluenzaB__AGX21128

SEQ ID NO: 118979 - RNA, 1758 nt, Artificial Sequence
  derived and/or modified sequence opt2 from hemagglutinin__InfluenzaB__AGX21139
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcgacuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118980 - RNA, 1758 nt, Artificial Sequence; identical to SEQ ID NO: 118195
  derived and/or modified sequence opt2 from hemagglutinin__InfluenzaB__AGX21150

SEQ ID NO: 118981 - RNA, 1758 nt, Artificial Sequence; identical to SEQ ID NO: 118120
  derived and/or modified sequence opt2 from hemagglutinin__InfluenzaB__AGX21161

SEQ ID NO: 118982 - RNA, 1758 nt, Artificial Sequence; identical to SEQ ID NO: 118195
  derived and/or modified sequence opt2 from hemagglutinin__InfluenzaB__AGX21172

SEQ ID NO: 118983 - RNA, 1758 nt, Artificial Sequence; identical to SEQ ID NO: 118157
  derived and/or modified sequence opt2 from hemagglutinin__InfluenzaB__AGX21183

SEQ ID NO: 118984 - RNA, 1758 nt, Artificial Sequence; identical to SEQ ID NO: 118195
  derived and/or modified sequence opt2 from hemagglutinin__InfluenzaB__AGX21194

SEQ ID NO: 118985 - RNA, 1758 nt, Artificial Sequence
  derived and/or modified sequence opt2 from hemagglutinin__InfluenzaB__AGX21205
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccaagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118986 - RNA, 1758 nt, Artificial Sequence; identical to SEQ ID NO: 118157
  derived and/or modified sequence opt2 from hemagglutinin__InfluenzaB__AGX21216

SEQ ID NO: 118987 - RNA, 1758 nt, Artificial Sequence; identical to SEQ ID NO: 118120
  derived and/or modified sequence opt2 from hemagglutinin__InfluenzaB__AGX21227

SEQ ID NO: 118988 - RNA, 1758 nt, Artificial Sequence
  derived and/or modified sequence opt2 from hemagglutinin__InfluenzaB__AGX21238
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccaacggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacaugaucucccgcgacaacgucuccugcuccaucugccucuga

SEQ ID NO: 118989 - RNA, 1758 nt, Artificial Sequence; identical to SEQ ID NO: 118195
  derived and/or modified sequence opt2 from hemagglutinin__InfluenzaB__AGX21249

SEQ ID NO: 118990 - RNA, 1758 nt, Artificial Sequence
  derived and/or modified sequence opt2 from hemagglutinin__InfluenzaB__AGX21260
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118991 - RNA, 1758 nt, Artificial Sequence; identical to SEQ ID NO: 118120
  derived and/or modified sequence opt2 from hemagglutinin__InfluenzaB__AGX21271

SEQ ID NO: 118992 - RNA, 1758 nt, Artificial Sequence
  derived and/or modified sequence opt2 from hemagglutinin__InfluenzaB__AGX21282
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccucccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccaagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118993 - RNA, 1758 nt, Artificial Sequence; identical to SEQ ID NO: 118157
  derived and/or modified sequence opt2 from hemagglutinin__InfluenzaB__AGX21293

SEQ ID NO: 118994 - RNA, 1758 nt, Artificial Sequence; identical to SEQ ID NO: 118195
  derived and/or modified sequence opt2 from hemagglutinin__InfluenzaB__AGX21304

SEQ ID NO: 118995 - RNA, 1758 nt, Artificial Sequence; identical to SEQ ID NO: 118157
  derived and/or modified sequence opt2 from hemagglutinin__InfluenzaB__AGX21315

SEQ ID NO: 118996 - RNA, 1758 nt, Artificial Sequence; identical to SEQ ID NO: 118120
  derived and/or modified sequence opt2 from hemagglutinin__InfluenzaB__AGX21326

SEQ ID NO: 118997 - RNA, 1758 nt, Artificial Sequence
  derived and/or modified sequence opt2 from hemagglutinin__InfluenzaB__AGX21337
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaaggagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 118998 - RNA, 1758 nt, Artificial Sequence; identical to SEQ ID NO: 118157
  derived and/or modified sequence opt2 from hemagglutinin__InfluenzaB__AGX21348

SEQ ID NO: 118999 - RNA, 1758 nt, Artificial Sequence; identical to SEQ ID NO: 118157
  derived and/or modified sequence opt2 from hemagglutinin__InfluenzaB__AGX21359

SEQ ID NO: 119000 - RNA, 1758 nt, Artificial Sequence
  derived and/or modified sequence opt2 from hemagglutinin__InfluenzaB__AGX21370
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaugggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119001 - RNA, 1758 nt, Artificial Sequence
  derived and/or modified sequence opt2 from hemagglutinin__InfluenzaB__AGX21381
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacaucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119002 - RNA, 1758 nt, Artificial Sequence
  derived and/or modified sequence opt2 from hemagglutinin__InfluenzaB__AGX21392
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119003 - RNA, 1758 nt, Artificial Sequence
  derived and/or modified sequence opt2 from hemagglutinin__InfluenzaB__AGX21403
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucaaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119004 - RNA, 1758 nt, Artificial Sequence
  derived and/or modified sequence opt2 from hemagglutinin__InfluenzaB__AGX21414
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccgacccccucaccaucgagguccccuacaucugcaccgagggcgaggaccagaucaccgucuggggcuuccacuccgacaacgagacccagauggccaagcucuacggcgacuccaagccccagaaguucaccuccuccuccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119005 - RNA, 1758 nt, Artificial Sequence; identical to SEQ ID NO: 118120
  derived and/or modified sequence opt2 from hemagglutinin__InfluenzaB__AGX21425

SEQ ID NO: 119006 - RNA, 1758 nt, Artificial Sequence
  derived and/or modified sequence opt2 from hemagglutinin__InfluenzaB__AGX21436
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgucgccuccucccucgccgucacccucaugaucgccaucuucgucgucuacauggucucccgcgacaacgucuccugcuccaucugccucuga

SEQ ID NO: 119007 - RNA, 1758 nt, Artificial Sequence; identical to SEQ ID NO: 118195
  derived and/or modified sequence opt2 from hemagglutinin__InfluenzaB__AGX21447

SEQ ID NO: 119008 - RNA, 1758 nt, Artificial Sequence; identical to SEQ ID NO: 118120
  derived and/or modified sequence opt2 from hemagglutinin__InfluenzaB__AGX21458

SEQ ID NO: 119009 - RNA, 1758 nt, Artificial Sequence; identical to SEQ ID NO: 118120
  derived and/or modified sequence opt2 from hemagglutinin__InfluenzaB__AGX21469

SEQ ID NO: 119010 - RNA, 1758 nt, Artificial Sequence
  derived and/or modified sequence opt2 from hemagglutinin__InfluenzaB__AGX21480
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgaggacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119011 - RNA, 1758 nt, Artificial Sequence; identical to SEQ ID NO: 118195
  derived and/or modified sequence opt2 from hemagglutinin__InfluenzaB__AGX21491

SEQ ID NO: 119012 - RNA, 1758 nt, Artificial Sequence; identical to SEQ ID NO: 118195
  derived and/or modified sequence opt2 from hemagglutinin__InfluenzaB__AGX21502

SEQ ID NO: 119013 - RNA, 1758 nt, Artificial Sequence; identical to SEQ ID NO: 118120
  derived and/or modified sequence opt2 from hemagglutinin__InfluenzaB__AGX21513

SEQ ID NO: 119014 - RNA, 1758 nt, Artificial Sequence; identical to SEQ ID NO: 118157
  derived and/or modified sequence opt2 from hemagglutinin__InfluenzaB__AGX21524

SEQ ID NO: 119015 - RNA, 1758 nt, Artificial Sequence
  derived and/or modified sequence opt2 from hemagglutinin__InfluenzaB__AGX21535
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119016 - RNA, 1758 nt, Artificial Sequence; identical to SEQ ID NO: 118157
  derived and/or modified sequence opt2 from hemagglutinin__InfluenzaB__AGX21546

SEQ ID NO: 119017 - RNA, 1758 nt, Artificial Sequence
  derived and/or modified sequence opt2 from hemagglutinin__InfluenzaB__AGX21557
augaaggccaucaucguccuccucauggucgucaccuccaacgccgaccgcaucugcaccggcaucaccuccuccaacuccccccacgucgucaagaccgccacccagggcgaggucaacgucaccggcgucaucacccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119018 - RNA, 1758 nt, Artificial Sequence
  derived and/or modified sequence opt2 from hemagglutinin__InfluenzaB__AGX21568
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaugaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119019 - RNA, 1758 nt, Artificial Sequence; identical to SEQ ID NO: 118120
  derived and/or modified sequence opt2 from hemagglutinin__InfluenzaB__AGX21579

SEQ ID NO: 119020 - RNA, 1758 nt, Artificial Sequence; identical to SEQ ID NO: 118157
  derived and/or modified sequence opt2 from hemagglutinin__InfluenzaB__AGX21590

SEQ ID NO: 119021 - RNA, 1758 nt, Artificial Sequence; identical to SEQ ID NO: 118970
  derived and/or modified sequence opt2 from hemagglutinin__InfluenzaB__AGX21601

SEQ ID NO: 119022 - RNA, 1758 nt, Artificial Sequence; identical to SEQ ID NO: 118157
  derived and/or modified sequence opt2 from hemagglutinin__InfluenzaB__AGX21611

SEQ ID NO: 119023 - RNA, 1758 nt, Artificial Sequence; identical to SEQ ID NO: 118501
  derived and/or modified sequence opt2 from hemagglutinin__InfluenzaB__AGX21622

SEQ ID NO: 119024 - RNA, 1758 nt, Artificial Sequence
  derived and/or modified sequence opt2 from hemagglutinin__InfluenzaB__AGX21633
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgcccgccuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119025 - RNA, 1758 nt, Artificial Sequence; identical to SEQ ID NO: 118195
  derived and/or modified sequence opt2 from hemagglutinin__InfluenzaB__AGX21644

SEQ ID NO: 119026 - RNA, 1758 nt, Artificial Sequence; identical to SEQ ID NO: 118120
  derived and/or modified sequence opt2 from hemagglutinin__InfluenzaB__AGX21655

SEQ ID NO: 119027 - RNA, 1758 nt, Artificial Sequence
  derived and/or modified sequence opt2 from hemagglutinin__InfluenzaB__AGX21666
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgacaagaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119028 - RNA, 1758 nt, Artificial Sequence; identical to SEQ ID NO: 118195
  derived and/or modified sequence opt2 from hemagglutinin__InfluenzaB__AGX21677

SEQ ID NO: 119029 - RNA, 1758 nt, Artificial Sequence; identical to SEQ ID NO: 118120
  derived and/or modified sequence opt2 from hemagglutinin__InfluenzaB__AGX21688

SEQ ID NO: 119030 - RNA, 1758 nt, Artificial Sequence
  derived and/or modified sequence opt2 from hemagglutinin__InfluenzaB__AGX21699
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaaccucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucuccgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119031 - RNA, 1758 nt, Artificial Sequence; identical to SEQ ID NO: 118970
  derived and/or modified sequence opt2 from hemagglutinin__InfluenzaB__AGX21710

SEQ ID NO: 119032 - RNA, 1758 nt, Artificial Sequence; identical to SEQ ID NO: 118195
  derived and/or modified sequence opt2 from hemagglutinin__InfluenzaB__AGX21721

SEQ ID NO: 119033 - RNA, 1755 nt, Artificial Sequence
  derived and/or modified sequence opt2 from hemagglutinin__InfluenzaB__AGX21732
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggcggccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccgcccagaacgucaucaacgccgagaaggcccccggcggccccuacaagcucggcaccuccggcuccugccccaacgccaccuccaaguccggcuucuucgccaccauggccugggccgucccccgcgacgacaacaagaccgccaccaacccccucaccgucgaggucccccacaucugcgccaacgaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119034 - RNA, 1755 nt, Artificial Sequence
  derived and/or modified sequence opt2 from hemagglutinin__InfluenzaB__AGX21743
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccucggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggcaaguccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119035 - RNA, 1755 nt, Artificial Sequence
  derived and/or modified sequence opt2 from hemagglutinin__InfluenzaB__AGX21754
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccgccaagucccacuucgccaaccucaagggcaccaagacccgcggcaagcucugccccaccugccucaacugcaccgaccucgacgucgcccucggcggccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccgcccagaacgucaucaacgccgagaaggcccccggcggccccuacaagcucggcaccuccggcuccugccccaacgccaccuccaaguccggcuucuucgccaccauggccugggccgucccccgcgacgacaacaagaccgccaccaacccccucaccgucgaggucccccacaucugcgccaacgaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119036 - RNA, 1755 nt, Artificial Sequence
  derived and/or modified sequence opt2 from hemagglutinin__InfluenzaB__AGX21776
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119037 - RNA, 1758 nt, Artificial Sequence; identical to SEQ ID NO: 118491
  derived and/or modified sequence opt2 from hemagglutinin__InfluenzaB__AGX21787

SEQ ID NO: 119038 - RNA, 1755 nt, Artificial Sequence
  derived and/or modified sequence opt2 from hemagglutinin__InfluenzaB__AGX21798
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119039 - RNA, 1755 nt, Artificial Sequence
  derived and/or modified sequence opt2 from hemagglutinin__InfluenzaB__AGX21809
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaagucccgccccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119040 - RNA, 1755 nt, Artificial Sequence
  derived and/or modified sequence opt2 from hemagglutinin__InfluenzaB__AGX21820
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccaacaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119041 - RNA, 1755 nt, Artificial Sequence; identical to SEQ ID NO: 118535
  derived and/or modified sequence opt2 from hemagglutinin__InfluenzaB__AGX21831

SEQ ID NO: 119042 - RNA, 1755 nt, Artificial Sequence; identical to SEQ ID NO: 118538
  derived and/or modified sequence opt2 from hemagglutinin__InfluenzaB__AGX21842

SEQ ID NO: 119043 - RNA, 1755 nt, Artificial Sequence; identical to SEQ ID NO: 118538
  derived and/or modified sequence opt2 from hemagglutinin__InfluenzaB__AGX21853

SEQ ID NO: 119044 - RNA, 1755 nt, Artificial Sequence
  derived and/or modified sequence opt2 from hemagglutinin__InfluenzaB__AGX21864
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccaaccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119045 - RNA, 1755 nt, Artificial Sequence; identical to SEQ ID NO: 118536
  derived and/or modified sequence opt2 from hemagglutinin__InfluenzaB__AGX21875

SEQ ID NO: 119046 - RNA, 1755 nt, Artificial Sequence; identical to SEQ ID NO: 118535
  derived and/or modified sequence opt2 from hemagglutinin__InfluenzaB__AGX21886

SEQ ID NO: 119047 - RNA, 1755 nt, Artificial Sequence; identical to SEQ ID NO: 118535
  derived and/or modified sequence opt2 from hemagglutinin__InfluenzaB__AGX21897

SEQ ID NO: 119048 - RNA, 1755 nt, Artificial Sequence; identical to SEQ ID NO: 118535
  derived and/or modified sequence opt2 from hemagglutinin__InfluenzaB__AGX21908

SEQ ID NO: 119049 - RNA, 1755 nt, Artificial Sequence
  derived and/or modified sequence opt2 from hemagglutinin__InfluenzaB__AGX21919
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaaggccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119050 - RNA, 1755 nt, Artificial Sequence; identical to SEQ ID NO: 118538
  derived and/or modified sequence opt2 from hemagglutinin__InfluenzaB__AGX21941

SEQ ID NO: 119051 - RNA, 1755 nt, Artificial Sequence; identical to SEQ ID NO: 118535
  derived and/or modified sequence opt2 from hemagglutinin__InfluenzaB__AGX21952

SEQ ID NO: 119052 - RNA, 1755 nt, Artificial Sequence; identical to SEQ ID NO: 118538
  derived and/or modified sequence opt2 from hemagglutinin__InfluenzaB__AGX21963

SEQ ID NO: 119053 - RNA, 1755 nt, Artificial Sequence
  derived and/or modified sequence opt2 from hemagglutinin__InfluenzaB__AGX21974
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggucaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacaugaucucccgcgacaacgucuccugcuccaucugccucuga

SEQ ID NO: 119054 - RNA, 1755 nt, Artificial Sequence; identical to SEQ ID NO: 118538
  derived and/or modified sequence opt2 from hemagglutinin__InfluenzaB__AGX21985

SEQ ID NO: 119055 - RNA, 1755 nt, Artificial Sequence; identical to SEQ ID NO: 118536
  derived and/or modified sequence opt2 from hemagglutinin__InfluenzaB__AGX21996

SEQ ID NO: 119056 - RNA, 1755 nt, Artificial Sequence; identical to SEQ ID NO: 118536
  derived and/or modified sequence opt2 from hemagglutinin__InfluenzaB__AGX22007

SEQ ID NO: 119057 - RNA, 1755 nt, Artificial Sequence; identical to SEQ ID NO: 118535
  derived and/or modified sequence opt2 from hemagglutinin__InfluenzaB__AGX22018

SEQ ID NO: 119058 - RNA, 1755 nt, Artificial Sequence; identical to SEQ ID NO: 118535
  derived and/or modified sequence opt2 from hemagglutinin__InfluenzaB__AGX22029

SEQ ID NO: 119059 - RNA, 1755 nt, Artificial Sequence; identical to SEQ ID NO: 118535
  derived and/or modified sequence opt2 from hemagglutinin__InfluenzaB__AGX22040

SEQ ID NO: 119060 - RNA, 1755 nt, Artificial Sequence
  derived and/or modified sequence opt2 from hemagglutinin__InfluenzaB__AGX22051
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaucgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgcccuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119061 - RNA, 1755 nt, Artificial Sequence; identical to SEQ ID NO: 118535
  derived and/or modified sequence opt2 from hemagglutinin__InfluenzaB__AGX22062

SEQ ID NO: 119062 - RNA, 1755 nt, Artificial Sequence
  derived and/or modified sequence opt2 from hemagglutinin__InfluenzaB__AGX22073
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuucaucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119063 - RNA, 1755 nt, Artificial Sequence; identical to SEQ ID NO: 118538
  derived and/or modified sequence opt2 from hemagglutinin__InfluenzaB__AGX22095

SEQ ID NO: 119064 - RNA, 1755 nt, Artificial Sequence; identical to SEQ ID NO: 118536
  derived and/or modified sequence opt2 from hemagglutinin__InfluenzaB__AGX22106

SEQ ID NO: 119065 - RNA, 1755 nt, Artificial Sequence
  derived and/or modified sequence opt2 from hemagglutinin__InfluenzaB__AGX22128
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgagaucaagaaccuccagcgccucuccggcgccaugaacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119066 - RNA, 1755 nt, Artificial Sequence
  derived and/or modified sequence opt2 from hemagglutinin__InfluenzaB__AGX22139
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccgaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119067 - RNA, 1755 nt, Artificial Sequence; identical to SEQ ID NO: 119066
  derived and/or modified sequence opt2 from hemagglutinin__InfluenzaB__AGX22150

SEQ ID NO: 119068 - RNA, 1755 nt, Artificial Sequence; identical to SEQ ID NO: 119066
  derived and/or modified sequence opt2 from hemagglutinin__InfluenzaB__AGX22161

SEQ ID NO: 119069 - RNA, 1755 nt, Artificial Sequence; identical to SEQ ID NO: 118535
  derived and/or modified sequence opt2 from hemagglutinin__InfluenzaB__AGX22172

SEQ ID NO: 119070 - RNA, 1755 nt, Artificial Sequence; identical to SEQ ID NO: 119066
  derived and/or modified sequence opt2 from hemagglutinin__InfluenzaB__AGX22183

SEQ ID NO: 119071 - RNA, 1755 nt, Artificial Sequence; identical to SEQ ID NO: 119066
  derived and/or modified sequence opt2 from hemagglutinin__InfluenzaB__AGX22194

SEQ ID NO: 119072 - RNA, 1755 nt, Artificial Sequence; identical to SEQ ID NO: 119066
  derived and/or modified sequence opt2 from hemagglutinin__InfluenzaB__AGX22205

SEQ ID NO: 119073 - RNA, 1755 nt, Artificial Sequence; identical to SEQ ID NO: 118536
  derived and/or modified sequence opt2 from hemagglutinin__InfluenzaB__AGX22216

SEQ ID NO: 119074 - RNA, 1755 nt, Artificial Sequence; identical to SEQ ID NO: 118538
  derived and/or modified sequence opt2 from hemagglutinin__InfluenzaB__AGX22227

SEQ ID NO: 119075 - RNA, 1755 nt, Artificial Sequence
  derived and/or modified sequence opt2 from hemagglutinin__InfluenzaB__AGX22238
augaaggccaucaucguccuccucauggucgucaccuccaacgccgaccgcaucugcaccggcaucaccuccuccaacuccccccacauggucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119076 - RNA, 1755 nt, Artificial Sequence; identical to SEQ ID NO: 118536
  derived and/or modified sequence opt2 from hemagglutinin__InfluenzaB__AGX22249

SEQ ID NO: 119077 - RNA, 1755 nt, Artificial Sequence; identical to SEQ ID NO: 118535
  derived and/or modified sequence opt2 from hemagglutinin__InfluenzaB__AGX22260

SEQ ID NO: 119078 - RNA, 1755 nt, Artificial Sequence
  derived and/or modified sequence opt2 from hemagglutinin__InfluenzaB__AGX22271
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgccccuccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119079 - RNA, 1755 nt, Artificial Sequence
  derived and/or modified sequence opt2 from hemagglutinin__InfluenzaB__AGX22282
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119080 - RNA, 1755 nt, Artificial Sequence; identical to SEQ ID NO: 118535
  derived and/or modified sequence opt2 from hemagglutinin__InfluenzaB__AGX22293

SEQ ID NO: 119081 - RNA, 1755 nt, Artificial Sequence
  derived and/or modified sequence opt2 from hemagglutinin__InfluenzaB__AGX22304
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccaccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119082 - RNA, 1755 nt, Artificial Sequence; identical to SEQ ID NO: 118535
  derived and/or modified sequence opt2 from hemagglutinin__InfluenzaB__AGX22315

SEQ ID NO: 119083 - RNA, 1755 nt, Artificial Sequence; identical to SEQ ID NO: 117938
  derived and/or modified sequence opt2 from hemagglutinin__InfluenzaB__AGX22326

SEQ ID NO: 119084 - RNA, 1755 nt, Artificial Sequence; identical to SEQ ID NO: 118538
  derived and/or modified sequence opt2 from hemagglutinin__InfluenzaB__AGX22337

SEQ ID NO: 119085 - RNA, 1755 nt, Artificial Sequence; identical to SEQ ID NO: 118538
  derived and/or modified sequence opt2 from hemagglutinin__InfluenzaB__AGX22348

SEQ ID NO: 119086 - RNA, 1755 nt, Artificial Sequence
  derived and/or modified sequence opt2 from hemagglutinin__InfluenzaB__AGX22359
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagcccaagaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgagaucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119087 - RNA, 1755 nt, Artificial Sequence; identical to SEQ ID NO: 118536
  derived and/or modified sequence opt2 from hemagglutinin__InfluenzaB__AGX22370

SEQ ID NO: 119088 - RNA, 1755 nt, Artificial Sequence
  derived and/or modified sequence opt2 from hemagglutinin__InfluenzaB__AGX22381
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucuccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119089 - RNA, 1755 nt, Artificial Sequence; identical to SEQ ID NO: 118535
  derived and/or modified sequence opt2 from hemagglutinin__InfluenzaB__AGX22392

SEQ ID NO: 119090 - RNA, 1755 nt, Artificial Sequence
  derived and/or modified sequence opt2 from hemagglutinin__InfluenzaB__AGX22403
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119091 - RNA, 1755 nt, Artificial Sequence; identical to SEQ ID NO: 118535
  derived and/or modified sequence opt2 from hemagglutinin__InfluenzaB__AGX22414

SEQ ID NO: 119092 - RNA, 1755 nt, Artificial Sequence
  derived and/or modified sequence opt2 from hemagglutinin__InfluenzaB__AGX22425
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagauccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119093 - RNA, 1755 nt, Artificial Sequence; identical to SEQ ID NO: 118536
  derived and/or modified sequence opt2 from hemagglutinin__InfluenzaB__AGX22436

SEQ ID NO: 119094 - RNA, 1755 nt, Artificial Sequence; identical to SEQ ID NO: 118536
  derived and/or modified sequence opt2 from hemagglutinin__InfluenzaB__AGX22445

SEQ ID NO: 119095 - RNA, 1755 nt, Artificial Sequence
  derived and/or modified sequence opt2 from hemagglutinin__InfluenzaB__AGX22456
augaaggccaucaucguccuccucauggucgucaccuccaacgccgaccgcaucugcaccggcaucaccuccuccuccuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacuccgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacaucgucucccgcgacaacgucuccugcuccaucugccucuga

SEQ ID NO: 119096 - RNA, 1755 nt, Artificial Sequence; identical to SEQ ID NO: 118535
  derived and/or modified sequence opt2 from hemagglutinin__InfluenzaB__AGX22467

SEQ ID NO: 119097 - RNA, 1755 nt, Artificial Sequence; identical to SEQ ID NO: 118535
  derived and/or modified sequence opt2 from hemagglutinin__InfluenzaB__AGX22478

SEQ ID NO: 119098 - RNA, 1755 nt, Artificial Sequence
  derived and/or modified sequence opt2 from hemagglutinin__InfluenzaB__AGX22489
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccaguccgccaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccggccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccgcccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119099 - RNA, 1755 nt, Artificial Sequence
  derived and/or modified sequence opt2 from hemagglutinin__InfluenzaB__AGX22500
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucaucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgucgccuccucccucgccgucacccucaugcucgccaucuucaucgucuacauggucucccgcgacaacgucuccugcuccaucugccucuga

SEQ ID NO: 119100 - RNA, 1755 nt, Artificial Sequence; identical to SEQ ID NO: 118536
  derived and/or modified sequence opt2 from hemagglutinin__InfluenzaB__AGX22511

SEQ ID NO: 119101 - RNA, 1755 nt, Artificial Sequence
  derived and/or modified sequence opt2 from hemagglutinin__InfluenzaB__AGX22522
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccaagcacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119102 - RNA, 1755 nt, Artificial Sequence; identical to SEQ ID NO: 117938
  derived and/or modified sequence opt2 from hemagglutinin__InfluenzaB__AGX22533

SEQ ID NO: 119103 - RNA, 1755 nt, Artificial Sequence; identical to SEQ ID NO: 118550
  derived and/or modified sequence opt2 from hemagglutinin__InfluenzaB__AGX22566

SEQ ID NO: 119104 - RNA, 1755 nt, Artificial Sequence; identical to SEQ ID NO: 118536
  derived and/or modified sequence opt2 from hemagglutinin__InfluenzaB__AGX22577

SEQ ID NO: 119105 - RNA, 1755 nt, Artificial Sequence; identical to SEQ ID NO: 118550
  derived and/or modified sequence opt2 from hemagglutinin__InfluenzaB__AGX22588

SEQ ID NO: 119106 - RNA, 1755 nt, Artificial Sequence; identical to SEQ ID NO: 117938
  derived and/or modified sequence opt2 from hemagglutinin__InfluenzaB__AGX22599

SEQ ID NO: 119107 - RNA, 1755 nt, Artificial Sequence
  derived and/or modified sequence opt2 from hemagglutinin__InfluenzaB__AGX22610
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgaccccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119108 - RNA, 1755 nt, Artificial Sequence
  derived and/or modified sequence opt2 from hemagglutinin__InfluenzaB__AGX22621
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccggcggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119109 - RNA, 1755 nt, Artificial Sequence; identical to SEQ ID NO: 117938
  derived and/or modified sequence opt2 from hemagglutinin__InfluenzaB__AGX22632

SEQ ID NO: 119110 - RNA, 1755 nt, Artificial Sequence
  derived and/or modified sequence opt2 from hemagglutinin__InfluenzaB__AGX22643
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccauccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119111 - RNA, 1755 nt, Artificial Sequence
  derived and/or modified sequence opt2 from hemagglutinin__InfluenzaB__AGX22654
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacuccgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119112 - RNA, 1755 nt, Artificial Sequence; identical to SEQ ID NO: 118550
  derived and/or modified sequence opt2 from hemagglutinin__InfluenzaB__AGX22665

SEQ ID NO: 119113 - RNA, 1755 nt, Artificial Sequence; identical to SEQ ID NO: 118550
  derived and/or modified sequence opt2 from hemagglutinin__InfluenzaB__AGX22676

SEQ ID NO: 119114 - RNA, 1755 nt, Artificial Sequence; identical to SEQ ID NO: 117938
  derived and/or modified sequence opt2 from hemagglutinin__InfluenzaB__AGX22687

SEQ ID NO: 119115 - RNA, 1755 nt, Artificial Sequence; identical to SEQ ID NO: 118550
  derived and/or modified sequence opt2 from hemagglutinin__InfluenzaB__AGX22698

SEQ ID NO: 119116 - RNA, 1755 nt, Artificial Sequence
  derived and/or modified sequence opt2 from hemagglutinin__InfluenzaB__AGX22709
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccgagaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119117 - RNA, 1755 nt, Artificial Sequence
  derived and/or modified sequence opt2 from hemagglutinin__InfluenzaB__AGX22720
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgccaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119118 - RNA, 1755 nt, Artificial Sequence; identical to SEQ ID NO: 118550
  derived and/or modified sequence opt2 from hemagglutinin__InfluenzaB__AGX22731

SEQ ID NO: 119119 - RNA, 1755 nt, Artificial Sequence; identical to SEQ ID NO: 119111
  derived and/or modified sequence opt2 from hemagglutinin__InfluenzaB__AGX22742

SEQ ID NO: 119120 - RNA, 1755 nt, Artificial Sequence
  derived and/or modified sequence opt2 from hemagglutinin__InfluenzaB__AGX22753
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccgccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119121 - RNA, 1755 nt, Artificial Sequence
  derived and/or modified sequence opt2 from hemagglutinin__InfluenzaB__AGX22764
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgaccacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119122 - RNA, 1755 nt, Artificial Sequence
  derived and/or modified sequence opt2 from hemagglutinin__InfluenzaB__AGX22775
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgccgccucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119123 - RNA, 1755 nt, Artificial Sequence; identical to SEQ ID NO: 118550
  derived and/or modified sequence opt2 from hemagglutinin__InfluenzaB__AGX22786

SEQ ID NO: 119124 - RNA, 1755 nt, Artificial Sequence
  derived and/or modified sequence opt2 from hemagglutinin__InfluenzaB__AGX22797
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccucuucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119125 - RNA, 1755 nt, Artificial Sequence; identical to SEQ ID NO: 118550
  derived and/or modified sequence opt2 from hemagglutinin__InfluenzaB__AGX22808

SEQ ID NO: 119126 - RNA, 1755 nt, Artificial Sequence; identical to SEQ ID NO: 118550
  derived and/or modified sequence opt2 from hemagglutinin__InfluenzaB__AGX22819

SEQ ID NO: 119127 - RNA, 1755 nt, Artificial Sequence; identical to SEQ ID NO: 118550
  derived and/or modified sequence opt2 from hemagglutinin__InfluenzaB__AGX22830

SEQ ID NO: 119128 - RNA, 1755 nt, Artificial Sequence
  derived and/or modified sequence opt2 from hemagglutinin__InfluenzaB__AGX22841
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccgacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119129 - RNA, 1755 nt, Artificial Sequence; identical to SEQ ID NO: 117938
  derived and/or modified sequence opt2 from hemagglutinin__InfluenzaB__AGX22852

SEQ ID NO: 119130 - RNA, 1755 nt, Artificial Sequence; identical to SEQ ID NO: 118550
  derived and/or modified sequence opt2 from hemagglutinin__InfluenzaB__AGX22863

SEQ ID NO: 119131 - RNA, 1755 nt, Artificial Sequence; identical to SEQ ID NO: 118550
  derived and/or modified sequence opt2 from hemagglutinin__InfluenzaB__AGX22874

SEQ ID NO: 119132 - RNA, 1755 nt, Artificial Sequence; identical to SEQ ID NO: 117938
  derived and/or modified sequence opt2 from hemagglutinin__InfluenzaB__AGX22885

SEQ ID NO: 119133 - RNA, 1755 nt, Artificial Sequence; identical to SEQ ID NO: 119111
  derived and/or modified sequence opt2 from hemagglutinin__InfluenzaB__AGX22896

SEQ ID NO: 119134 - RNA, 1755 nt, Artificial Sequence
  derived and/or modified sequence opt2 from hemagglutinin__InfluenzaB__AGX22907
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacuccgucuccugcuccaucugccucuga

SEQ ID NO: 119135 - RNA, 1755 nt, Artificial Sequence; identical to SEQ ID NO: 117938
  derived and/or modified sequence opt2 from hemagglutinin__InfluenzaB__AGX22918

SEQ ID NO: 119136 - RNA, 1755 nt, Artificial Sequence; identical to SEQ ID NO: 117938
  derived and/or modified sequence opt2 from hemagglutinin__InfluenzaB__AGX22929

SEQ ID NO: 119137 - RNA, 1755 nt, Artificial Sequence; identical to SEQ ID NO: 118550
  derived and/or modified sequence opt2 from hemagglutinin__InfluenzaB__AGX22940

SEQ ID NO: 119138 - RNA, 1755 nt, Artificial Sequence; identical to SEQ ID NO: 117938
  derived and/or modified sequence opt2 from hemagglutinin__InfluenzaB__AGX22951

SEQ ID NO: 119139 - RNA, 1755 nt, Artificial Sequence; identical to SEQ ID NO: 117938
  derived and/or modified sequence opt2 from hemagglutinin__InfluenzaB__AGX22962

SEQ ID NO: 119140 - RNA, 1755 nt, Artificial Sequence; identical to SEQ ID NO: 117938
  derived and/or modified sequence opt2 from hemagglutinin__InfluenzaB__AGX22973

SEQ ID NO: 119141 - RNA, 1755 nt, Artificial Sequence; identical to SEQ ID NO: 117938
  derived and/or modified sequence opt2 from hemagglutinin__InfluenzaB__AGX22984

SEQ ID NO: 119142 - RNA, 1755 nt, Artificial Sequence; identical to SEQ ID NO: 117938
  derived and/or modified sequence opt2 from hemagglutinin__InfluenzaB__AGX22995

SEQ ID NO: 119143 - RNA, 1755 nt, Artificial Sequence; identical to SEQ ID NO: 117938
  derived and/or modified sequence opt2 from hemagglutinin__InfluenzaB__AGX23006

SEQ ID NO: 119144 - RNA, 1755 nt, Artificial Sequence
  derived and/or modified sequence opt2 from hemagglutinin__InfluenzaB__AGX23017
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagauccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119145 - RNA, 1755 nt, Artificial Sequence
  derived and/or modified sequence opt2 from hemagglutinin__InfluenzaB__AGX23028
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuacaagcucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119146 - RNA, 1755 nt, Artificial Sequence; identical to SEQ ID NO: 117938
  derived and/or modified sequence opt2 from hemagglutinin__InfluenzaB__AGX23039

SEQ ID NO: 119147 - RNA, 1755 nt, Artificial Sequence
  derived and/or modified sequence opt2 from hemagglutinin__InfluenzaB__AGX23050
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgaggucucccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccuccgccucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119148 - RNA, 1755 nt, Artificial Sequence
  derived and/or modified sequence opt2 from hemagglutinin__InfluenzaB__AGX23061
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccuccgccucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119149 - RNA, 1755 nt, Artificial Sequence; identical to SEQ ID NO: 117938
  derived and/or modified sequence opt2 from hemagglutinin__InfluenzaB__AGX23072

SEQ ID NO: 119150 - RNA, 1755 nt, Artificial Sequence; identical to SEQ ID NO: 118550
  derived and/or modified sequence opt2 from hemagglutinin__InfluenzaB__AGX23083

SEQ ID NO: 119151 - RNA, 1755 nt, Artificial Sequence; identical to SEQ ID NO: 117938
  derived and/or modified sequence opt2 from hemagglutinin__InfluenzaB__AGX23094

SEQ ID NO: 119152 - RNA, 1755 nt, Artificial Sequence; identical to SEQ ID NO: 117938
  derived and/or modified sequence opt2 from hemagglutinin__InfluenzaB__AGX23105

SEQ ID NO: 119153 - RNA, 1755 nt, Artificial Sequence; identical to SEQ ID NO: 118550
  derived and/or modified sequence opt2 from hemagglutinin__InfluenzaB__AGX23116

SEQ ID NO: 119154 - RNA, 1755 nt, Artificial Sequence; identical to SEQ ID NO: 117938
  derived and/or modified sequence opt2 from hemagglutinin__InfluenzaB__AGX23127

SEQ ID NO: 119155 - RNA, 1755 nt, Artificial Sequence; identical to SEQ ID NO: 117938
  derived and/or modified sequence opt2 from hemagglutinin__InfluenzaB__AGX23138

SEQ ID NO: 119156 - RNA, 1755 nt, Artificial Sequence
  derived and/or modified sequence opt2 from hemagglutinin__InfluenzaB__AGX23149
augaaggccaucaucguccuccucauggucgucaccuccaacgccgaccgcaucugcaccggcaucaccuccuccgacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119157 - RNA, 1755 nt, Artificial Sequence
  derived and/or modified sequence opt2 from hemagglutinin__InfluenzaB__AGX23160
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagcgcuucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccuccgccucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119158 - RNA, 1755 nt, Artificial Sequence
  derived and/or modified sequence opt2 from hemagglutinin__InfluenzaB__AGX23171
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagcgcuucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccuccgccucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119159 - RNA, 1755 nt, Artificial Sequence; identical to SEQ ID NO: 117938
  derived and/or modified sequence opt2 from hemagglutinin__InfluenzaB__AGX23182

SEQ ID NO: 119160 - RNA, 1755 nt, Artificial Sequence; identical to SEQ ID NO: 117938
  derived and/or modified sequence opt2 from hemagglutinin__InfluenzaB__AGX23193

SEQ ID NO: 119161 - RNA, 1755 nt, Artificial Sequence; identical to SEQ ID NO: 118550
  derived and/or modified sequence opt2 from hemagglutinin__InfluenzaB__AGX23204

SEQ ID NO: 119162 - RNA, 1755 nt, Artificial Sequence; identical to SEQ ID NO: 117938
  derived and/or modified sequence opt2 from hemagglutinin__InfluenzaB__AGX23215

SEQ ID NO: 119163 - RNA, 1755 nt, Artificial Sequence
  derived and/or modified sequence opt2 from hemagglutinin__InfluenzaB__AGX23226
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccuccggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119164 - RNA, 1755 nt, Artificial Sequence; identical to SEQ ID NO: 119111
  derived and/or modified sequence opt2 from hemagglutinin__InfluenzaB__AGX23237

SEQ ID NO: 119165 - RNA, 1755 nt, Artificial Sequence
  derived and/or modified sequence opt2 from hemagglutinin__InfluenzaB__AGX23248
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccuccggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucaaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119166 - RNA, 1755 nt, Artificial Sequence; identical to SEQ ID NO: 117938
  derived and/or modified sequence opt2 from hemagglutinin__InfluenzaB__AGX23259

SEQ ID NO: 119167 - RNA, 1755 nt, Artificial Sequence; identical to SEQ ID NO: 117938
  derived and/or modified sequence opt2 from hemagglutinin__InfluenzaB__AGX23270

SEQ ID NO: 119168 - RNA, 1755 nt, Artificial Sequence
  derived and/or modified sequence opt2 from hemagglutinin__InfluenzaB__AGX23281
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccgccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacuccgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119169 - RNA, 1755 nt, Artificial Sequence
  derived and/or modified sequence opt2 from hemagglutinin__InfluenzaB__AGX23292
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaacuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119170 - RNA, 1755 nt, Artificial Sequence
  derived and/or modified sequence opt2 from hemagglutinin__InfluenzaB__AGX23314
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagcgcgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119171 - RNA, 1755 nt, Artificial Sequence; identical to SEQ ID NO: 119170
  derived and/or modified sequence opt2 from hemagglutinin__InfluenzaB__AGX23325

SEQ ID NO: 119172 - RNA, 1755 nt, Artificial Sequence; identical to SEQ ID NO: 119170
  derived and/or modified sequence opt2 from hemagglutinin__InfluenzaB__AGX23336

SEQ ID NO: 119173 - RNA, 1755 nt, Artificial Sequence; identical to SEQ ID NO: 119170
  derived and/or modified sequence opt2 from hemagglutinin__InfluenzaB__AGX23347

SEQ ID NO: 119174 - RNA, 1755 nt, Artificial Sequence; identical to SEQ ID NO: 119170
  derived and/or modified sequence opt2 from hemagglutinin__InfluenzaB__AGX23358

SEQ ID NO: 119175 - RNA, 1755 nt, Artificial Sequence; identical to SEQ ID NO: 119170
  derived and/or modified sequence opt2 from hemagglutinin__InfluenzaB__AGX23369

SEQ ID NO: 119176 - RNA, 1755 nt, Artificial Sequence; identical to SEQ ID NO: 119170
  derived and/or modified sequence opt2 from hemagglutinin__InfluenzaB__AGX23380

SEQ ID NO: 119177 - RNA, 1755 nt, Artificial Sequence; identical to SEQ ID NO: 117938
  derived and/or modified sequence opt2 from hemagglutinin__InfluenzaB__AGX23391

SEQ ID NO: 119178 - RNA, 1755 nt, Artificial Sequence
  derived and/or modified sequence opt2 from hemagglutinin__InfluenzaB__AGX23413
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccaaccagaacgucaucgacgccgagcgcgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119179 - RNA, 1755 nt, Artificial Sequence; identical to SEQ ID NO: 119178
  derived and/or modified sequence opt2 from hemagglutinin__InfluenzaB__AGX23424

SEQ ID NO: 119180 - RNA, 1755 nt, Artificial Sequence; identical to SEQ ID NO: 118332
  derived and/or modified sequence opt2 from hemagglutinin__InfluenzaB__AGX23435

SEQ ID NO: 119181 - RNA, 1755 nt, Artificial Sequence; identical to SEQ ID NO: 118243
  derived and/or modified sequence opt2 from hemagglutinin__InfluenzaB__AGX23446

SEQ ID NO: 119182 - RNA, 1755 nt, Artificial Sequence; identical to SEQ ID NO: 118332
  derived and/or modified sequence opt2 from hemagglutinin__InfluenzaB__AGX23457

SEQ ID NO: 119183 - RNA, 1755 nt, Artificial Sequence; identical to SEQ ID NO: 118243
  derived and/or modified sequence opt2 from hemagglutinin__InfluenzaB__AGX23468

SEQ ID NO: 119184 - RNA, 1755 nt, Artificial Sequence; identical to SEQ ID NO: 117938
  derived and/or modified sequence opt2 from hemagglutinin__InfluenzaB__AGX23479

SEQ ID NO: 119185 - RNA, 1755 nt, Artificial Sequence; identical to SEQ ID NO: 117938
  derived and/or modified sequence opt2 from hemagglutinin__InfluenzaB__AGX23490

SEQ ID NO: 119186 - RNA, 1755 nt, Artificial Sequence; identical to SEQ ID NO: 118559
  derived and/or modified sequence opt2 from hemagglutinin__InfluenzaB__AGX23501

SEQ ID NO: 119187 - RNA, 1755 nt, Artificial Sequence
  derived and/or modified sequence opt2 from hemagglutinin__InfluenzaB__AGX23512
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagacccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119188 - RNA, 1755 nt, Artificial Sequence; identical to SEQ ID NO: 117938
  derived and/or modified sequence opt2 from hemagglutinin__InfluenzaB__AGX23523

SEQ ID NO: 119189 - RNA, 1755 nt, Artificial Sequence; identical to SEQ ID NO: 118243
  derived and/or modified sequence opt2 from hemagglutinin__InfluenzaB__AGX23534

SEQ ID NO: 119190 - RNA, 1755 nt, Artificial Sequence; identical to SEQ ID NO: 118243
  derived and/or modified sequence opt2 from hemagglutinin__InfluenzaB__AGX23545

SEQ ID NO: 119191 - RNA, 1755 nt, Artificial Sequence; identical to SEQ ID NO: 117938
  derived and/or modified sequence opt2 from hemagglutinin__InfluenzaB__AGX23556

SEQ ID NO: 119192 - RNA, 1755 nt, Artificial Sequence; identical to SEQ ID NO: 117938
  derived and/or modified sequence opt2 from hemagglutinin__InfluenzaB__AGX23567

SEQ ID NO: 119193 - RNA, 1755 nt, Artificial Sequence; identical to SEQ ID NO: 117938
  derived and/or modified sequence opt2 from hemagglutinin__InfluenzaB__AGX23578

SEQ ID NO: 119194 - RNA, 1755 nt, Artificial Sequence; identical to SEQ ID NO: 117938
  derived and/or modified sequence opt2 from hemagglutinin__InfluenzaB__AGX23600

SEQ ID NO: 119195 - RNA, 1755 nt, Artificial Sequence
  derived and/or modified sequence opt2 from hemagglutinin__InfluenzaB__AGX23611
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgagaucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119196 - RNA, 1755 nt, Artificial Sequence; identical to SEQ ID NO: 117938
  derived and/or modified sequence opt2 from hemagglutinin__InfluenzaB__AGX23622

SEQ ID NO: 119197 - RNA, 1755 nt, Artificial Sequence; identical to SEQ ID NO: 118243
  derived and/or modified sequence opt2 from hemagglutinin__InfluenzaB__AGX23633

SEQ ID NO: 119198 - RNA, 1755 nt, Artificial Sequence; identical to SEQ ID NO: 118243
  derived and/or modified sequence opt2 from hemagglutinin__InfluenzaB__AGX23644

SEQ ID NO: 119199 - RNA, 1755 nt, Artificial Sequence; identical to SEQ ID NO: 117938
  derived and/or modified sequence opt2 from hemagglutinin__InfluenzaB__AGX23655

SEQ ID NO: 119200 - RNA, 1755 nt, Artificial Sequence; identical to SEQ ID NO: 118243
  derived and/or modified sequence opt2 from hemagglutinin__InfluenzaB__AGX23666

SEQ ID NO: 119201 - RNA, 1755 nt, Artificial Sequence
  derived and/or modified sequence opt2 from hemagglutinin__InfluenzaB__AGX23677
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaagauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaucgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119202 - RNA, 1755 nt, Artificial Sequence; identical to SEQ ID NO: 118243
  derived and/or modified sequence opt2 from hemagglutinin__InfluenzaB__AGX23688

SEQ ID NO: 119203 - RNA, 1755 nt, Artificial Sequence; identical to SEQ ID NO: 118243
  derived and/or modified sequence opt2 from hemagglutinin__InfluenzaB__AGX23699

SEQ ID NO: 119204 - RNA, 1755 nt, Artificial Sequence; identical to SEQ ID NO: 117938
  derived and/or modified sequence opt2 from hemagglutinin__InfluenzaB__AGX23710

SEQ ID NO: 119205 - RNA, 1755 nt, Artificial Sequence; identical to SEQ ID NO: 118243
  derived and/or modified sequence opt2 from hemagglutinin__InfluenzaB__AGX23721

SEQ ID NO: 119206 - RNA, 1755 nt, Artificial Sequence; identical to SEQ ID NO: 117938
  derived and/or modified sequence opt2 from hemagglutinin__InfluenzaB__AGX23732

SEQ ID NO: 119207 - RNA, 1755 nt, Artificial Sequence; identical to SEQ ID NO: 118243
  derived and/or modified sequence opt2 from hemagglutinin__InfluenzaB__AGX23743

SEQ ID NO: 119208 - RNA, 1755 nt, Artificial Sequence; identical to SEQ ID NO: 118243
  derived and/or modified sequence opt2 from hemagglutinin__InfluenzaB__AGX23754

SEQ ID NO: 119209 - RNA, 1755 nt, Artificial Sequence; identical to SEQ ID NO: 117938
  derived and/or modified sequence opt2 from hemagglutinin__InfluenzaB__AGX23765

SEQ ID NO: 119210 - RNA, 1755 nt, Artificial Sequence; identical to SEQ ID NO: 118243
  derived and/or modified sequence opt2 from hemagglutinin__InfluenzaB__AGX23776

SEQ ID NO: 119211 - RNA, 1755 nt, Artificial Sequence; identical to SEQ ID NO: 118243
  derived and/or modified sequence opt2 from hemagglutinin__InfluenzaB__AGX23787

SEQ ID NO: 119212 - RNA, 1755 nt, Artificial Sequence; identical to SEQ ID NO: 117938
  derived and/or modified sequence opt2 from hemagglutinin__InfluenzaB__AGX23798

SEQ ID NO: 119213 - RNA, 1755 nt, Artificial Sequence; identical to SEQ ID NO: 117938
  derived and/or modified sequence opt2 from hemagglutinin__InfluenzaB__AGX23809

SEQ ID NO: 119214 - RNA, 1755 nt, Artificial Sequence; identical to SEQ ID NO: 117938
  derived and/or modified sequence opt2 from hemagglutinin__InfluenzaB__AGX23820

SEQ ID NO: 119215 - RNA, 1755 nt, Artificial Sequence; identical to SEQ ID NO: 118243
  derived and/or modified sequence opt2 from hemagglutinin__InfluenzaB__AGX23831

SEQ ID NO: 119216 - RNA, 1755 nt, Artificial Sequence; identical to SEQ ID NO: 117938
  derived and/or modified sequence opt2 from hemagglutinin__InfluenzaB__AGX23842

SEQ ID NO: 119217 - RNA, 1755 nt, Artificial Sequence
  derived and/or modified sequence opt2 from hemagglutinin__InfluenzaB__AGX23853
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccauccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaaguccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119218 - RNA, 1755 nt, Artificial Sequence; identical to SEQ ID NO: 117938
  derived and/or modified sequence opt2 from hemagglutinin__InfluenzaB__AGX23864

SEQ ID NO: 119219 - RNA, 1755 nt, Artificial Sequence; identical to SEQ ID NO: 118243
  derived and/or modified sequence opt2 from hemagglutinin__InfluenzaB__AGX23875

SEQ ID NO: 119220 - RNA, 1755 nt, Artificial Sequence; identical to SEQ ID NO: 117938
  derived and/or modified sequence opt2 from hemagglutinin__InfluenzaB__AGX23886

SEQ ID NO: 119221 - RNA, 1755 nt, Artificial Sequence
  derived and/or modified sequence opt2 from hemagglutinin__InfluenzaB__AGX23897
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaaguccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119222 - RNA, 1755 nt, Artificial Sequence
  derived and/or modified sequence opt2 from hemagglutinin__InfluenzaB__AGX23908
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgucaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119223 - RNA, 1755 nt, Artificial Sequence; identical to SEQ ID NO: 118079
  derived and/or modified sequence opt2 from hemagglutinin__InfluenzaB__AGX23919

SEQ ID NO: 119224 - RNA, 1755 nt, Artificial Sequence; identical to SEQ ID NO: 118559
  derived and/or modified sequence opt2 from hemagglutinin__InfluenzaB__AGX23930

SEQ ID NO: 119225 - RNA, 1755 nt, Artificial Sequence; identical to SEQ ID NO: 117938
  derived and/or modified sequence opt2 from hemagglutinin__InfluenzaB__AGX23941

SEQ ID NO: 119226 - RNA, 1755 nt, Artificial Sequence; identical to SEQ ID NO: 118243
  derived and/or modified sequence opt2 from hemagglutinin__InfluenzaB__AGX23952

SEQ ID NO: 119227 - RNA, 1755 nt, Artificial Sequence; identical to SEQ ID NO: 118243
  derived and/or modified sequence opt2 from hemagglutinin__InfluenzaB__AGX23963

SEQ ID NO: 119228 - RNA, 1755 nt, Artificial Sequence; identical to SEQ ID NO: 118559
  derived and/or modified sequence opt2 from hemagglutinin__InfluenzaB__AGX23974

SEQ ID NO: 119229 - RNA, 1755 nt, Artificial Sequence; identical to SEQ ID NO: 118079
  derived and/or modified sequence opt2 from hemagglutinin__InfluenzaB__AGX23985

SEQ ID NO: 119230 - RNA, 1755 nt, Artificial Sequence
  derived and/or modified sequence opt2 from hemagglutinin__InfluenzaB__AGX23996
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccaucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119231 - RNA, 1755 nt, Artificial Sequence; identical to SEQ ID NO: 118559
  derived and/or modified sequence opt2 from hemagglutinin__InfluenzaB__AGX24007

SEQ ID NO: 119232 - RNA, 1755 nt, Artificial Sequence; identical to SEQ ID NO: 118559
  derived and/or modified sequence opt2 from hemagglutinin__InfluenzaB__AGX24018

SEQ ID NO: 119233 - RNA, 1755 nt, Artificial Sequence
  derived and/or modified sequence opt2 from hemagglutinin__InfluenzaB__AGX24029
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucaaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119234 - RNA, 1755 nt, Artificial Sequence; identical to SEQ ID NO: 118559
  derived and/or modified sequence opt2 from hemagglutinin__InfluenzaB__AGX24040

SEQ ID NO: 119235 - RNA, 1755 nt, Artificial Sequence; identical to SEQ ID NO: 118243
  derived and/or modified sequence opt2 from hemagglutinin__InfluenzaB__AGX24051

SEQ ID NO: 119236 - RNA, 1755 nt, Artificial Sequence; identical to SEQ ID NO: 118332
  derived and/or modified sequence opt2 from hemagglutinin__InfluenzaB__AGX24062

SEQ ID NO: 119237 - RNA, 1755 nt, Artificial Sequence; identical to SEQ ID NO: 118079
  derived and/or modified sequence opt2 from hemagglutinin__InfluenzaB__AGX24073

SEQ ID NO: 119238 - RNA, 1755 nt, Artificial Sequence
  derived and/or modified sequence opt2 from hemagglutinin__InfluenzaB__AGX24084
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccaucauccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119239 - RNA, 1755 nt, Artificial Sequence; identical to SEQ ID NO: 118559
  derived and/or modified sequence opt2 from hemagglutinin__InfluenzaB__AGX24095

SEQ ID NO: 119240 - RNA, 1755 nt, Artificial Sequence
  derived and/or modified sequence opt2 from hemagglutinin__InfluenzaB__AGX24106
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacaccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119241 - RNA, 1755 nt, Artificial Sequence
  derived and/or modified sequence opt2 from hemagglutinin__InfluenzaB__AGX24117
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacaccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119242 - RNA, 1755 nt, Artificial Sequence
  derived and/or modified sequence opt2 from hemagglutinin__InfluenzaB__AGX24128
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugcauccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119243 - RNA, 1755 nt, Artificial Sequence; identical to SEQ ID NO: 117938
  derived and/or modified sequence opt2 from hemagglutinin__InfluenzaB__AGX24139

SEQ ID NO: 119244 - RNA, 1755 nt, Artificial Sequence
  derived and/or modified sequence opt2 from hemagglutinin__InfluenzaB__AGX24150
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccuacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119245 - RNA, 1755 nt, Artificial Sequence; identical to SEQ ID NO: 118559
  derived and/or modified sequence opt2 from hemagglutinin__InfluenzaB__AGX24161

SEQ ID NO: 119246 - RNA, 1755 nt, Artificial Sequence; identical to SEQ ID NO: 118332
  derived and/or modified sequence opt2 from hemagglutinin__InfluenzaB__AGX24172

SEQ ID NO: 119247 - RNA, 1755 nt, Artificial Sequence; identical to SEQ ID NO: 118332
  derived and/or modified sequence opt2 from hemagglutinin__InfluenzaB__AGX24183

SEQ ID NO: 119248 - RNA, 1755 nt, Artificial Sequence; identical to SEQ ID NO: 118332
  derived and/or modified sequence opt2 from hemagglutinin__InfluenzaB__AGX24194

SEQ ID NO: 119249 - RNA, 1755 nt, Artificial Sequence; identical to SEQ ID NO: 118079
  derived and/or modified sequence opt2 from hemagglutinin__InfluenzaB__AGX24205

SEQ ID NO: 119250 - RNA, 1755 nt, Artificial Sequence; identical to SEQ ID NO: 118243
  derived and/or modified sequence opt2 from hemagglutinin__InfluenzaB__AGX24227

SEQ ID NO: 119251 - RNA, 1755 nt, Artificial Sequence; identical to SEQ ID NO: 118332
  derived and/or modified sequence opt2 from hemagglutinin__InfluenzaB__AGX24238

SEQ ID NO: 119252 - RNA, 1755 nt, Artificial Sequence
  derived and/or modified sequence opt2 from hemagglutinin__InfluenzaB__AGX24249
augaaggccaucaucguccuccucauggucgucaccuccaacgccgaccgcaucugcaccggcaucaccuccuccaaguccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119253 - RNA, 1755 nt, Artificial Sequence; identical to SEQ ID NO: 118079
  derived and/or modified sequence opt2 from hemagglutinin__InfluenzaB__AGX24260

SEQ ID NO: 119254 - RNA, 1755 nt, Artificial Sequence; identical to SEQ ID NO: 118568
  derived and/or modified sequence opt2 from hemagglutinin__InfluenzaB__AGX24271

SEQ ID NO: 119255 - RNA, 1755 nt, Artificial Sequence
  derived and/or modified sequence opt2 from hemagglutinin__InfluenzaB__AGX24282
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119256 - RNA, 1755 nt, Artificial Sequence; identical to SEQ ID NO: 118079
  derived and/or modified sequence opt2 from hemagglutinin__InfluenzaB__AGX24293

SEQ ID NO: 119257 - RNA, 1755 nt, Artificial Sequence; identical to SEQ ID NO: 118079
  derived and/or modified sequence opt2 from hemagglutinin__InfluenzaB__AGX24304

SEQ ID NO: 119258 - RNA, 1755 nt, Artificial Sequence; identical to SEQ ID NO: 118568
  derived and/or modified sequence opt2 from hemagglutinin__InfluenzaB__AGX24315

SEQ ID NO: 119259 - RNA, 1755 nt, Artificial Sequence
  derived and/or modified sequence opt2 from hemagglutinin__InfluenzaB__AGX24326
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaccugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119260 - RNA, 1755 nt, Artificial Sequence
  derived and/or modified sequence opt2 from hemagglutinin__InfluenzaB__AGX24337
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggcaugcccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119261 - RNA, 1755 nt, Artificial Sequence; identical to SEQ ID NO: 118332
  derived and/or modified sequence opt2 from hemagglutinin__InfluenzaB__AGX24348

SEQ ID NO: 119262 - RNA, 1755 nt, Artificial Sequence; identical to SEQ ID NO: 118079
  derived and/or modified sequence opt2 from hemagglutinin__InfluenzaB__AGX24359

SEQ ID NO: 119263 - RNA, 1755 nt, Artificial Sequence; identical to SEQ ID NO: 118332
  derived and/or modified sequence opt2 from hemagglutinin__InfluenzaB__AGX24381

SEQ ID NO: 119264 - RNA, 1755 nt, Artificial Sequence
  derived and/or modified sequence opt2 from hemagglutinin__InfluenzaB__AGX24392
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagauccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119265 - RNA, 1755 nt, Artificial Sequence; identical to SEQ ID NO: 118079
  derived and/or modified sequence opt2 from hemagglutinin__InfluenzaB__AGX24403

SEQ ID NO: 119266 - RNA, 1755 nt, Artificial Sequence; identical to SEQ ID NO: 118332
  derived and/or modified sequence opt2 from hemagglutinin__InfluenzaB__AGX24414

SEQ ID NO: 119267 - RNA, 1755 nt, Artificial Sequence; identical to SEQ ID NO: 118079
  derived and/or modified sequence opt2 from hemagglutinin__InfluenzaB__AGX24425

SEQ ID NO: 119268 - RNA, 1755 nt, Artificial Sequence; identical to SEQ ID NO: 118079
  derived and/or modified sequence opt2 from hemagglutinin__InfluenzaB__AGX24436

SEQ ID NO: 119269 - RNA, 1755 nt, Artificial Sequence; identical to SEQ ID NO: 118568
  derived and/or modified sequence opt2 from hemagglutinin__InfluenzaB__AGX24447

SEQ ID NO: 119270 - RNA, 1755 nt, Artificial Sequence; identical to SEQ ID NO: 119259
  derived and/or modified sequence opt2 from hemagglutinin__InfluenzaB__AGX24458

SEQ ID NO: 119271 - RNA, 1755 nt, Artificial Sequence
  derived and/or modified sequence opt2 from hemagglutinin__InfluenzaB__AGX24469
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaccugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcauggucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119272 - RNA, 1755 nt, Artificial Sequence; identical to SEQ ID NO: 118568
  derived and/or modified sequence opt2 from hemagglutinin__InfluenzaB__AGX24480

SEQ ID NO: 119273 - RNA, 1755 nt, Artificial Sequence; identical to SEQ ID NO: 118568
  derived and/or modified sequence opt2 from hemagglutinin__InfluenzaB__AGX24491

SEQ ID NO: 119274 - RNA, 1755 nt, Artificial Sequence
  derived and/or modified sequence opt2 from hemagglutinin__InfluenzaB__AGX24502
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccagaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119275 - RNA, 1755 nt, Artificial Sequence; identical to SEQ ID NO: 118243
  derived and/or modified sequence opt2 from hemagglutinin__InfluenzaB__AGX24513

SEQ ID NO: 119276 - RNA, 1755 nt, Artificial Sequence; identical to SEQ ID NO: 118568
  derived and/or modified sequence opt2 from hemagglutinin__InfluenzaB__AGX24524

SEQ ID NO: 119277 - RNA, 1755 nt, Artificial Sequence
  derived and/or modified sequence opt2 from hemagglutinin__InfluenzaB__AGX24535
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccgcccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119278 - RNA, 1755 nt, Artificial Sequence; identical to SEQ ID NO: 118079
  derived and/or modified sequence opt2 from hemagglutinin__InfluenzaB__AGX24546

SEQ ID NO: 119279 - RNA, 1755 nt, Artificial Sequence
  derived and/or modified sequence opt2 from hemagglutinin__InfluenzaB__AGX24557
augaagaccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaccugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119280 - RNA, 1755 nt, Artificial Sequence; identical to SEQ ID NO: 118568
  derived and/or modified sequence opt2 from hemagglutinin__InfluenzaB__AGX24579

SEQ ID NO: 119281 - RNA, 1755 nt, Artificial Sequence; identical to SEQ ID NO: 118568
  derived and/or modified sequence opt2 from hemagglutinin__InfluenzaB__AGX24590

SEQ ID NO: 119282 - RNA, 1755 nt, Artificial Sequence; identical to SEQ ID NO: 118568
  derived and/or modified sequence opt2 from hemagglutinin__InfluenzaB__AGX24601

SEQ ID NO: 119283 - RNA, 1755 nt, Artificial Sequence; identical to SEQ ID NO: 118568
  derived and/or modified sequence opt2 from hemagglutinin__InfluenzaB__AGX24612

SEQ ID NO: 119284 - RNA, 1755 nt, Artificial Sequence; identical to SEQ ID NO: 118079
  derived and/or modified sequence opt2 from hemagglutinin__InfluenzaB__AGX24623

SEQ ID NO: 119285 - RNA, 1755 nt, Artificial Sequence; identical to SEQ ID NO: 118568
  derived and/or modified sequence opt2 from hemagglutinin__InfluenzaB__AGX24634

SEQ ID NO: 119286 - RNA, 1755 nt, Artificial Sequence; identical to SEQ ID NO: 119277
  derived and/or modified sequence opt2 from hemagglutinin__InfluenzaB__AGX24656

SEQ ID NO: 119287 - RNA, 1755 nt, Artificial Sequence; identical to SEQ ID NO: 118079
  derived and/or modified sequence opt2 from hemagglutinin__InfluenzaB__AGX24667

SEQ ID NO: 119288 - RNA, 1755 nt, Artificial Sequence; identical to SEQ ID NO: 118332
  derived and/or modified sequence opt2 from hemagglutinin__InfluenzaB__AGX24678

SEQ ID NO: 119289 - RNA, 1755 nt, Artificial Sequence; identical to SEQ ID NO: 118568
  derived and/or modified sequence opt2 from hemagglutinin__InfluenzaB__AGX24689

SEQ ID NO: 119290 - RNA, 1755 nt, Artificial Sequence; identical to SEQ ID NO: 118568
  derived and/or modified sequence opt2 from hemagglutinin__InfluenzaB__AGX24700

SEQ ID NO: 119291 - RNA, 1755 nt, Artificial Sequence; identical to SEQ ID NO: 118568
  derived and/or modified sequence opt2 from hemagglutinin__InfluenzaB__AGX24711

SEQ ID NO: 119292 - RNA, 1755 nt, Artificial Sequence; identical to SEQ ID NO: 118079
  derived and/or modified sequence opt2 from hemagglutinin__InfluenzaB__AGX24722

SEQ ID NO: 119293 - RNA, 1755 nt, Artificial Sequence; identical to SEQ ID NO: 118079
  derived and/or modified sequence opt2 from hemagglutinin__InfluenzaB__AGX24733

SEQ ID NO: 119294 - RNA, 1755 nt, Artificial Sequence; identical to SEQ ID NO: 118079
  derived and/or modified sequence opt2 from hemagglutinin__InfluenzaB__AGX24744

SEQ ID NO: 119295 - RNA, 1755 nt, Artificial Sequence; identical to SEQ ID NO: 118079
  derived and/or modified sequence opt2 from hemagglutinin__InfluenzaB__AGX24755

SEQ ID NO: 119296 - RNA, 1755 nt, Artificial Sequence; identical to SEQ ID NO: 118568
  derived and/or modified sequence opt2 from hemagglutinin__InfluenzaB__AGX24766

SEQ ID NO: 119297 - RNA, 1755 nt, Artificial Sequence; identical to SEQ ID NO: 118079
  derived and/or modified sequence opt2 from hemagglutinin__InfluenzaB__AGX24777

SEQ ID NO: 119298 - RNA, 1755 nt, Artificial Sequence; identical to SEQ ID NO: 118079
  derived and/or modified sequence opt2 from hemagglutinin__InfluenzaB__AGX24788

SEQ ID NO: 119299 - RNA, 1755 nt, Artificial Sequence; identical to SEQ ID NO: 118079
  derived and/or modified sequence opt2 from hemagglutinin__InfluenzaB__AGX24799

SEQ ID NO: 119300 - RNA, 1755 nt, Artificial Sequence; identical to SEQ ID NO: 118568
  derived and/or modified sequence opt2 from hemagglutinin__InfluenzaB__AGX24810

SEQ ID NO: 119301 - RNA, 1755 nt, Artificial Sequence; identical to SEQ ID NO: 118568
  derived and/or modified sequence opt2 from hemagglutinin__InfluenzaB__AGX24821

SEQ ID NO: 119302 - RNA, 1755 nt, Artificial Sequence
  derived and/or modified sequence opt2 from hemagglutinin__InfluenzaB__AGX24832
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcauccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119303 - RNA, 1755 nt, Artificial Sequence
  derived and/or modified sequence opt2 from hemagglutinin__InfluenzaB__AGX24843
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagcgcgucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119304 - RNA, 1755 nt, Artificial Sequence
  derived and/or modified sequence opt2 from hemagglutinin__InfluenzaB__AGX24854
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgagugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagcgccccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119305 - RNA, 1755 nt, Artificial Sequence
  derived and/or modified sequence opt2 from hemagglutinin__InfluenzaB__AGX24865
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagcgccccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119306 - RNA, 1755 nt, Artificial Sequence
  derived and/or modified sequence opt2 from hemagglutinin__InfluenzaB__AGX24876
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacucccucaccgucgagguccccuacaucugcaaggagggcgaggaccagaucaccgucuggggcuuccacuccgacaacaagccccagaugaagaaccucuacggcgacuccaacccccagaaguucaccuccuccgccaacggcgucaccacccacuacgucucccaggucggcgacuuccccgaccagaccgaggacggcggccucccccaguccggccgcaucgucgucgacuacaugaugcagaagcccggccgcaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119307 - RNA, 1755 nt, Artificial Sequence
  derived and/or modified sequence opt2 from hemagglutinin__InfluenzaB__AGX24887
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccauguccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119308 - RNA, 1755 nt, Artificial Sequence
  derived and/or modified sequence opt2 from hemagglutinin__InfluenzaB__AGX24898
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccggcggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119309 - RNA, 1758 nt, Artificial Sequence; identical to SEQ ID NO: 118195
  derived and/or modified sequence opt2 from hemagglutinin__InfluenzaB__AGX84854

SEQ ID NO: 119310 - RNA, 1758 nt, Artificial Sequence
  derived and/or modified sequence opt2 from hemagglutinin__InfluenzaB__AGX84865
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119311 - RNA, 1758 nt, Artificial Sequence; identical to SEQ ID NO: 119310
  derived and/or modified sequence opt2 from hemagglutinin__InfluenzaB__AGX84876

SEQ ID NO: 119312 - RNA, 1758 nt, Artificial Sequence; identical to SEQ ID NO: 119310
  derived and/or modified sequence opt2 from hemagglutinin__InfluenzaB__AGX84887

SEQ ID NO: 119313 - RNA, 1758 nt, Artificial Sequence; identical to SEQ ID NO: 118195
  derived and/or modified sequence opt2 from hemagglutinin__InfluenzaB__AGX84898

SEQ ID NO: 119314 - RNA, 1758 nt, Artificial Sequence
  derived and/or modified sequence opt2 from hemagglutinin__InfluenzaB__AGX84920
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgccggcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119315 - RNA, 1758 nt, Artificial Sequence
  derived and/or modified sequence opt2 from hemagglutinin__InfluenzaB__AGZ59821
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugcuucaacugcaccgaccucgacgucgcccucggccgccccaagugcaccggcaacauccccuccgccaaggucuccauccuccacgagguccgccccgucaccuccggcugcuuccccaucaugcacgaccgcaccaagguccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119316 - RNA, 1758 nt, Artificial Sequence
  derived and/or modified sequence opt2 from hemagglutinin__InfluenzaB__AGZ59832
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggcaaguccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgaggacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119317 - RNA, 1758 nt, Artificial Sequence
  derived and/or modified sequence opt2 from hemagglutinin__InfluenzaB__AGZ59843
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119318 - RNA, 1758 nt, Artificial Sequence; identical to SEQ ID NO: 118664
  derived and/or modified sequence opt2 from hemagglutinin__InfluenzaB__AGZ59854

SEQ ID NO: 119319 - RNA, 1758 nt, Artificial Sequence; identical to SEQ ID NO: 118026
  derived and/or modified sequence opt2 from hemagglutinin__InfluenzaB__AGZ59865

SEQ ID NO: 119320 - RNA, 1758 nt, Artificial Sequence
  derived and/or modified sequence opt2 from hemagglutinin__InfluenzaB__AGZ59876
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119321 - RNA, 1755 nt, Artificial Sequence; identical to SEQ ID NO: 118079
  derived and/or modified sequence opt2 from hemagglutinin__InfluenzaB__AGZ59887

SEQ ID NO: 119322 - RNA, 1758 nt, Artificial Sequence; identical to SEQ ID NO: 118501
  derived and/or modified sequence opt2 from hemagglutinin__InfluenzaB__AGZ59898

SEQ ID NO: 119323 - RNA, 1758 nt, Artificial Sequence; identical to SEQ ID NO: 118867
  derived and/or modified sequence opt2 from hemagglutinin__InfluenzaB__AGZ59909

SEQ ID NO: 119324 - RNA, 1758 nt, Artificial Sequence; identical to SEQ ID NO: 118501
  derived and/or modified sequence opt2 from hemagglutinin__InfluenzaB__AGZ59920

SEQ ID NO: 119325 - RNA, 1758 nt, Artificial Sequence; identical to SEQ ID NO: 118501
  derived and/or modified sequence opt2 from hemagglutinin__InfluenzaB__AGZ59931

SEQ ID NO: 119326 - RNA, 1758 nt, Artificial Sequence; identical to SEQ ID NO: 118501
  derived and/or modified sequence opt2 from hemagglutinin__InfluenzaB__AGZ59942

SEQ ID NO: 119327 - RNA, 1758 nt, Artificial Sequence; identical to SEQ ID NO: 118501
  derived and/or modified sequence opt2 from hemagglutinin__InfluenzaB__AGZ59953

SEQ ID NO: 119328 - RNA, 1758 nt, Artificial Sequence
  derived and/or modified sequence opt2 from hemagglutinin__InfluenzaB__AGZ59965
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcgucgucgucgacuacaugaugcagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119329 - RNA, 1758 nt, Artificial Sequence; identical to SEQ ID NO: 118501
  derived and/or modified sequence opt2 from hemagglutinin__InfluenzaB__AGZ59976

SEQ ID NO: 119330 - RNA, 1758 nt, Artificial Sequence; identical to SEQ ID NO: 118501
  derived and/or modified sequence opt2 from hemagglutinin__InfluenzaB__AGZ59987

SEQ ID NO: 119331 - RNA, 1758 nt, Artificial Sequence; identical to SEQ ID NO: 118501
  derived and/or modified sequence opt2 from hemagglutinin__InfluenzaB__AGZ59999

SEQ ID NO: 119332 - RNA, 1758 nt, Artificial Sequence; identical to SEQ ID NO: 118120
  derived and/or modified sequence opt2 from hemagglutinin__InfluenzaB__AGZ60010

SEQ ID NO: 119333 - RNA, 1758 nt, Artificial Sequence; identical to SEQ ID NO: 118120
  derived and/or modified sequence opt2 from hemagglutinin__InfluenzaB__AGZ60021

SEQ ID NO: 119334 - RNA, 1758 nt, Artificial Sequence; identical to SEQ ID NO: 118120
  derived and/or modified sequence opt2 from hemagglutinin__InfluenzaB__AGZ60033

SEQ ID NO: 119335 - RNA, 1755 nt, Artificial Sequence
  derived and/or modified sequence opt2 from hemagglutinin__InfluenzaB__AGZ60044
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119336 - RNA, 1755 nt, Artificial Sequence; identical to SEQ ID NO: 118538
  derived and/or modified sequence opt2 from hemagglutinin__InfluenzaB__AGZ60055

SEQ ID NO: 119337 - RNA, 1755 nt, Artificial Sequence
  derived and/or modified sequence opt2 from hemagglutinin__InfluenzaB__AGZ60066
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccucggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119338 - RNA, 1755 nt, Artificial Sequence
  derived and/or modified sequence opt2 from hemagglutinin__InfluenzaB__AGZ60077
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggcucccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaaguccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacuccgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119339 - RNA, 1755 nt, Artificial Sequence; identical to SEQ ID NO: 118243
  derived and/or modified sequence opt2 from hemagglutinin__InfluenzaB__AGZ60088

SEQ ID NO: 119340 - RNA, 1755 nt, Artificial Sequence; identical to SEQ ID NO: 117938
  derived and/or modified sequence opt2 from hemagglutinin__InfluenzaB__AGZ60099

SEQ ID NO: 119341 - RNA, 1755 nt, Artificial Sequence
  derived and/or modified sequence opt2 from hemagglutinin__InfluenzaB__AGZ60131
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccaucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119342 - RNA, 1755 nt, Artificial Sequence; identical to SEQ ID NO: 118243
  derived and/or modified sequence opt2 from hemagglutinin__InfluenzaB__AGZ60142

SEQ ID NO: 119343 - RNA, 1755 nt, Artificial Sequence; identical to SEQ ID NO: 118243
  derived and/or modified sequence opt2 from hemagglutinin__InfluenzaB__AGZ60160

SEQ ID NO: 119344 - RNA, 1755 nt, Artificial Sequence; identical to SEQ ID NO: 118332
  derived and/or modified sequence opt2 from hemagglutinin__InfluenzaB__AGZ60172

SEQ ID NO: 119345 - RNA, 1755 nt, Artificial Sequence; identical to SEQ ID NO: 118332
  derived and/or modified sequence opt2 from hemagglutinin__InfluenzaB__AGZ60183

SEQ ID NO: 119346 - RNA, 1755 nt, Artificial Sequence
  derived and/or modified sequence opt2 from hemagglutinin__InfluenzaB__AGZ60194
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagaccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119347 - RNA, 1755 nt, Artificial Sequence
  derived and/or modified sequence opt2 from hemagglutinin__InfluenzaB__AGZ60206
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaucaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119348 - RNA, 1755 nt, Artificial Sequence; identical to SEQ ID NO: 119277
  derived and/or modified sequence opt2 from hemagglutinin__InfluenzaB__AGZ60217

SEQ ID NO: 119349 - RNA, 1755 nt, Artificial Sequence
  derived and/or modified sequence opt2 from hemagglutinin__InfluenzaB__AGZ60268
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccaucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119350 - RNA, 1755 nt, Artificial Sequence; identical to SEQ ID NO: 118366
  derived and/or modified sequence opt2 from hemagglutinin__InfluenzaB__AHE37993

SEQ ID NO: 119351 - RNA, 1755 nt, Artificial Sequence; identical to SEQ ID NO: 118411
  derived and/or modified sequence opt2 from hemagglutinin__InfluenzaB__AHE37994

SEQ ID NO: 119352 - RNA, 1755 nt, Artificial Sequence; identical to SEQ ID NO: 118366
  derived and/or modified sequence opt2 from hemagglutinin__InfluenzaB__AHE37995

SEQ ID NO: 119353 - RNA, 1755 nt, Artificial Sequence; identical to SEQ ID NO: 118366
  derived and/or modified sequence opt2 from hemagglutinin__InfluenzaB__AHE37996

SEQ ID NO: 119354 - RNA, 1755 nt, Artificial Sequence; identical to SEQ ID NO: 118411
  derived and/or modified sequence opt2 from hemagglutinin__InfluenzaB__AHE37997

SEQ ID NO: 119355 - RNA, 1755 nt, Artificial Sequence; identical to SEQ ID NO: 118411
  derived and/or modified sequence opt2 from hemagglutinin__InfluenzaB__AHE37998

SEQ ID NO: 119356 - RNA, 1755 nt, Artificial Sequence; identical to SEQ ID NO: 118411
  derived and/or modified sequence opt2 from hemagglutinin__InfluenzaB__AHE37999

SEQ ID NO: 119357 - RNA, 1755 nt, Artificial Sequence; identical to SEQ ID NO: 118366
  derived and/or modified sequence opt2 from hemagglutinin__InfluenzaB__AHE38000

SEQ ID NO: 119358 - RNA, 1755 nt, Artificial Sequence; identical to SEQ ID NO: 118366
  derived and/or modified sequence opt2 from hemagglutinin__InfluenzaB__AHE38001

SEQ ID NO: 119359 - RNA, 1755 nt, Artificial Sequence
  derived and/or modified sequence opt2 from hemagglutinin__InfluenzaB__AHE38002
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccaagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119360 - RNA, 1755 nt, Artificial Sequence; identical to SEQ ID NO: 118366
  derived and/or modified sequence opt2 from hemagglutinin__InfluenzaB__AHE38003

SEQ ID NO: 119361 - RNA, 1755 nt, Artificial Sequence; identical to SEQ ID NO: 118366
  derived and/or modified sequence opt2 from hemagglutinin__InfluenzaB__AHE38004

SEQ ID NO: 119362 - RNA, 1755 nt, Artificial Sequence; identical to SEQ ID NO: 118366
  derived and/or modified sequence opt2 from hemagglutinin__InfluenzaB__AHE38005

SEQ ID NO: 119363 - RNA, 1755 nt, Artificial Sequence
  derived and/or modified sequence opt2 from hemagglutinin__InfluenzaB__AHE38006
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcgccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccgucgacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119364 - RNA, 1755 nt, Artificial Sequence; identical to SEQ ID NO: 118366
  derived and/or modified sequence opt2 from hemagglutinin__InfluenzaB__AHE38007

SEQ ID NO: 119365 - RNA, 1755 nt, Artificial Sequence
  derived and/or modified sequence opt2 from hemagglutinin__InfluenzaB__AHE38008
augaaggccaucaucgcccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119366 - RNA, 1755 nt, Artificial Sequence; identical to SEQ ID NO: 118411
  derived and/or modified sequence opt2 from hemagglutinin__InfluenzaB__AHE38009

SEQ ID NO: 119367 - RNA, 1755 nt, Artificial Sequence; identical to SEQ ID NO: 118411
  derived and/or modified sequence opt2 from hemagglutinin__InfluenzaB__AHE38010

SEQ ID NO: 119368 - RNA, 1755 nt, Artificial Sequence; identical to SEQ ID NO: 118366
  derived and/or modified sequence opt2 from hemagglutinin__InfluenzaB__AHE38012

SEQ ID NO: 119369 - RNA, 1755 nt, Artificial Sequence
  derived and/or modified sequence opt2 from hemagglutinin__InfluenzaB__AHE38013
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgucuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcauggccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119370 - RNA, 1755 nt, Artificial Sequence; identical to SEQ ID NO: 118366
  derived and/or modified sequence opt2 from hemagglutinin__InfluenzaB__AHE38014

SEQ ID NO: 119371 - RNA, 1758 nt, Artificial Sequence; identical to SEQ ID NO: 118157
  derived and/or modified sequence opt2 from hemagglutinin__InfluenzaB__AHE38015

SEQ ID NO: 119372 - RNA, 1758 nt, Artificial Sequence
  derived and/or modified sequence opt2 from hemagglutinin__InfluenzaB__AHE38016
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggcaaguccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaucauccuccucuacuacuccaccgccgccuccucccucgccgucacccucaugaucgccaucuucgucgucuacauggucucccgcgacaacgucuccugcuccaucugccucuga

SEQ ID NO: 119373 - RNA, 1758 nt, Artificial Sequence; identical to SEQ ID NO: 118476
  derived and/or modified sequence opt2 from hemagglutinin__InfluenzaB__AHE38017

SEQ ID NO: 119374 - RNA, 1758 nt, Artificial Sequence; identical to SEQ ID NO: 118399
  derived and/or modified sequence opt2 from hemagglutinin__InfluenzaB__AHE38018

SEQ ID NO: 119375 - RNA, 1758 nt, Artificial Sequence; identical to SEQ ID NO: 118384
  derived and/or modified sequence opt2 from hemagglutinin__InfluenzaB__AHE38019

SEQ ID NO: 119376 - RNA, 1758 nt, Artificial Sequence
  derived and/or modified sequence opt2 from hemagglutinin__InfluenzaB__AHE38020
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaucacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119377 - RNA, 1758 nt, Artificial Sequence
  derived and/or modified sequence opt2 from hemagglutinin__InfluenzaB__AHE38021
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119378 - RNA, 1758 nt, Artificial Sequence; identical to SEQ ID NO: 118399
  derived and/or modified sequence opt2 from hemagglutinin__InfluenzaB__AHE38022

SEQ ID NO: 119379 - RNA, 1752 nt, Artificial Sequence
  derived and/or modified sequence opt2 from hemagglutinin__InfluenzaB__AHL91189
augaaggccaucaucguccuccucauggucgccaccuccaacgccgaccgcaucugcaccggcaucaccuccuccaacuccccccacgucgucaagaccgccacccagggcgaggucaacgucaccggcgucaucucccucaccaccacccccaccaagucccacuucgccaaccucaagggcaccaagacccgcggcaagcucugccccaacugccucaacugcaccgaccucgacgucgcccucggccgccccaucugcaucggcaccauccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119380 - RNA, 1752 nt, Artificial Sequence
  derived and/or modified sequence opt2 from hemagglutinin__InfluenzaB__AHL91200
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119381 - RNA, 1752 nt, Artificial Sequence
  derived and/or modified sequence opt2 from hemagglutinin__InfluenzaB__AHL91211
augaaggccaucaucguccuccucauggucgccaccuccaacgccgaccgcaucugcaccggcaucaccuccuccaacuccccccacgucgucaagaccgccacccagggcgaggucaacgucaccggcgucaucucccucaccaccacccccaccaagucccacuucgccaaccucaagggcaccaagacccgcggcaagcucugccccaacugccucaacugcaccgaccucgacgucgcccucggccgccccaugugcaucggcaccauccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119382 - RNA, 1755 nt, Artificial Sequence
  derived and/or modified sequence opt2 from hemagglutinin__InfluenzaB__AHL91222
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacgucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacaucuccugcuccaucugccucuga

SEQ ID NO: 119383 - RNA, 1755 nt, Artificial Sequence
  derived and/or modified sequence opt2 from hemagglutinin__InfluenzaB__AHL91244
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119384 - RNA, 1755 nt, Artificial Sequence; identical to SEQ ID NO: 118013
  derived and/or modified sequence opt2 from hemagglutinin__InfluenzaB__AHL91255

SEQ ID NO: 119385 - RNA, 1755 nt, Artificial Sequence; identical to SEQ ID NO: 118013
  derived and/or modified sequence opt2 from hemagglutinin__InfluenzaB__AHL91266

SEQ ID NO: 119386 - RNA, 1752 nt, Artificial Sequence
  derived and/or modified sequence opt2 from hemagglutinin__InfluenzaB__AHL91277
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucggccgccccaugugcaucggcaucacccccuccgccaaggccuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagcgcgcccccggcggccccuaccgccucggcaccuccggcuccugccccaacgucaccucccgcuccggcuucuucgccaccauggccugggccgucccccgcgacaacaagaccgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119387 - RNA, 1755 nt, Artificial Sequence
  derived and/or modified sequence opt2 from hemagglutinin__InfluenzaB__AHL91299
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccacccgcucccacuucgccaaccucaagggcaccaagacccgcggcaagcucugccccaccugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119388 - RNA, 1755 nt, Artificial Sequence
  derived and/or modified sequence opt2 from hemagglutinin__InfluenzaB__AHL91310
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119389 - RNA, 1755 nt, Artificial Sequence
  derived and/or modified sequence opt2 from hemagglutinin__InfluenzaB__AHL91321
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaccugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgagguccccuacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagaagggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119390 - RNA, 1755 nt, Artificial Sequence; identical to SEQ ID NO: 119388
  derived and/or modified sequence opt2 from hemagglutinin__InfluenzaB__AHL91332

SEQ ID NO: 119391 - RNA, 1755 nt, Artificial Sequence; identical to SEQ ID NO: 119388
  derived and/or modified sequence opt2 from hemagglutinin__InfluenzaB__AHL91343

SEQ ID NO: 119392 - RNA, 1755 nt, Artificial Sequence; identical to SEQ ID NO: 119388
  derived and/or modified sequence opt2 from hemagglutinin__InfluenzaB__AHL91354

SEQ ID NO: 119393 - RNA, 1755 nt, Artificial Sequence; identical to SEQ ID NO: 117991
  derived and/or modified sequence opt2 from hemagglutinin__InfluenzaB__AHL91365

SEQ ID NO: 119394 - RNA, 1755 nt, Artificial Sequence
  derived and/or modified sequence opt2 from hemagglutinin__InfluenzaB__AHL91376
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccgccacccccaccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119395 - RNA, 1755 nt, Artificial Sequence
  derived and/or modified sequence opt2 from hemagglutinin__InfluenzaB__AHL91387
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccgccaagucccacuucgccaaccucaagggcaccaagacccgcggcaagcucugccccaccugccucaacugcaccgaccucgacgucgcccucggccgccccaugugcgucggcgucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119396 - RNA, 1755 nt, Artificial Sequence
  derived and/or modified sequence opt2 from hemagglutinin__InfluenzaB__AHL91409
augaaggccaucaucguccuccucauggucgucaccuccaacgccgaccgcaucugcaccggcaucaccuccuccgacuccccccacgucgucaagaccgccacccagggcgaggucaacgucaccggcgccaucccccucaccaccacccccaccaaguccuacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccucccgcuccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcauggucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119397 - RNA, 1755 nt, Artificial Sequence
  derived and/or modified sequence opt2 from hemagglutinin__InfluenzaB__AHL91431
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacuuccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119398 - RNA, 1755 nt, Artificial Sequence
  derived and/or modified sequence opt2 from hemagglutinin__InfluenzaB__AHL91442
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaccgcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119399 - RNA, 1755 nt, Artificial Sequence
  derived and/or modified sequence opt2 from hemagglutinin__InfluenzaB__AHL91453
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccaucgaggucccccacgucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119400 - RNA, 1755 nt, Artificial Sequence; identical to SEQ ID NO: 117917
  derived and/or modified sequence opt2 from hemagglutinin__InfluenzaB__AHL91464

SEQ ID NO: 119401 - RNA, 1755 nt, Artificial Sequence; identical to SEQ ID NO: 118023
  derived and/or modified sequence opt2 from hemagglutinin__InfluenzaB__AHL91475

SEQ ID NO: 119402 - RNA, 1755 nt, Artificial Sequence; identical to SEQ ID NO: 119398
  derived and/or modified sequence opt2 from hemagglutinin__InfluenzaB__AHL91486

SEQ ID NO: 119403 - RNA, 1755 nt, Artificial Sequence; identical to SEQ ID NO: 119398
  derived and/or modified sequence opt2 from hemagglutinin__InfluenzaB__AHL91497

SEQ ID NO: 119404 - RNA, 1755 nt, Artificial Sequence; identical to SEQ ID NO: 119398
  derived and/or modified sequence opt2 from hemagglutinin__InfluenzaB__AHL91530

SEQ ID NO: 119405 - RNA, 1755 nt, Artificial Sequence; identical to SEQ ID NO: 117917
  derived and/or modified sequence opt2 from hemagglutinin__InfluenzaB__AHL91541

SEQ ID NO: 119406 - RNA, 1755 nt, Artificial Sequence; identical to SEQ ID NO: 119398
  derived and/or modified sequence opt2 from hemagglutinin__InfluenzaB__AHL91552

SEQ ID NO: 119407 - RNA, 1755 nt, Artificial Sequence; identical to SEQ ID NO: 119398
  derived and/or modified sequence opt2 from hemagglutinin__InfluenzaB__AHL91574

SEQ ID NO: 119408 - RNA, 1755 nt, Artificial Sequence
  derived and/or modified sequence opt2 from hemagglutinin__InfluenzaB__AHL91585
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaugaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119409 - RNA, 1755 nt, Artificial Sequence
  derived and/or modified sequence opt2 from hemagglutinin__InfluenzaB__AHL91596
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagauccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119410 - RNA, 1755 nt, Artificial Sequence; identical to SEQ ID NO: 119409
  derived and/or modified sequence opt2 from hemagglutinin__InfluenzaB__AHL91607

SEQ ID NO: 119411 - RNA, 1755 nt, Artificial Sequence
  derived and/or modified sequence opt2 from hemagglutinin__InfluenzaB__AHL91618
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaccgcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgucggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119412 - RNA, 1755 nt, Artificial Sequence
  derived and/or modified sequence opt2 from hemagglutinin__InfluenzaB__AHL91629
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugcuucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuacaagcucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119413 - RNA, 1755 nt, Artificial Sequence; identical to SEQ ID NO: 119412
  derived and/or modified sequence opt2 from hemagglutinin__InfluenzaB__AHL91640

SEQ ID NO: 119414 - RNA, 1755 nt, Artificial Sequence; identical to SEQ ID NO: 117919
  derived and/or modified sequence opt2 from hemagglutinin__InfluenzaB__AHL91651

SEQ ID NO: 119415 - RNA, 1752 nt, Artificial Sequence
  derived and/or modified sequence opt2 from hemagglutinin__InfluenzaB__AHL91662
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaccgcccccggcggccccuaccgccucggcaccuccggcuccugccccaacgccaccuccaaguccggcuucuucgccaccauggccugggccgucccccgcgacaacaacaagaccgccaccaacccccucaccgucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119416 - RNA, 1755 nt, Artificial Sequence; identical to SEQ ID NO: 118023
  derived and/or modified sequence opt2 from hemagglutinin__InfluenzaB__AHL91673

SEQ ID NO: 119417 - RNA, 1755 nt, Artificial Sequence
  derived and/or modified sequence opt2 from hemagglutinin__InfluenzaB__AHL91684
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaagucccacuucgccaaccucaagggcaccaagacccgcggcaagcucugccccaccugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucaacgccgagaaggcccccggcggccccuaccgccucggcaccuccggcuccugccccaacgccaccuccaaguccggcuucuucgccaccauggccugggccgucccccgcgacaacaacaagaccgccaccaacccccucaccaucgaggucccccacaucugcaccaaggaggaggaccagaucaccgucuggggcuuccacuccgacaacaagacccagaugaagaaccucuacggcgacuccaacccccagaaguucaccuccuccgccaacggcaucaccacccacuacgucucccagaucggcggcuuccccgaccagaccgaggacggcggccucccccaguccggccgcaucgucgucgacuacaugguccagaagcccggcaagaccggcaccaucgucuaccagcgcggcauccuccucccccagaaggucuggugcgccuccggccgcuccaaggucaucaagggcuuccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacaugaucucccgcgacaacgucuccugcuccaucugccucuga

SEQ ID NO: 119418 - RNA, 1755 nt, Artificial Sequence; identical to SEQ ID NO: 117919
  derived and/or modified sequence opt2 from hemagglutinin__InfluenzaB__AHL91695

SEQ ID NO: 119419 - RNA, 1755 nt, Artificial Sequence; identical to SEQ ID NO: 118023
  derived and/or modified sequence opt2 from hemagglutinin__InfluenzaB__AHL91706

SEQ ID NO: 119420 - RNA, 1758 nt, Artificial Sequence; identical to SEQ ID NO: 118491
  derived and/or modified sequence opt2 from hemagglutinin__InfluenzaB__AHL91717

SEQ ID NO: 119421 - RNA, 1758 nt, Artificial Sequence; identical to SEQ ID NO: 118491
  derived and/or modified sequence opt2 from hemagglutinin__InfluenzaB__AHL91728

SEQ ID NO: 119422 - RNA, 1758 nt, Artificial Sequence; identical to SEQ ID NO: 118491
  derived and/or modified sequence opt2 from hemagglutinin__InfluenzaB__AHL91739

SEQ ID NO: 119423 - RNA, 1755 nt, Artificial Sequence; identical to SEQ ID NO: 118023
  derived and/or modified sequence opt2 from hemagglutinin__InfluenzaB__AHL91750

SEQ ID NO: 119424 - RNA, 1758 nt, Artificial Sequence; identical to SEQ ID NO: 118491
  derived and/or modified sequence opt2 from hemagglutinin__InfluenzaB__AHL91761

SEQ ID NO: 119425 - RNA, 1758 nt, Artificial Sequence
  derived and/or modified sequence opt2 from hemagglutinin__InfluenzaB__AHL91772
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccaaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacaucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119426 - RNA, 1758 nt, Artificial Sequence; identical to SEQ ID NO: 119425
  derived and/or modified sequence opt2 from hemagglutinin__InfluenzaB__AHL91783

SEQ ID NO: 119427 - RNA, 1758 nt, Artificial Sequence; identical to SEQ ID NO: 119425
  derived and/or modified sequence opt2 from hemagglutinin__InfluenzaB__AHL91794

SEQ ID NO: 119428 - RNA, 1758 nt, Artificial Sequence
  derived and/or modified sequence opt2 from hemagglutinin__InfluenzaB__AHL91805
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugcuucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119429 - RNA, 1758 nt, Artificial Sequence; identical to SEQ ID NO: 117931
  derived and/or modified sequence opt2 from hemagglutinin__InfluenzaB__AHL91816

SEQ ID NO: 119430 - RNA, 1758 nt, Artificial Sequence; identical to SEQ ID NO: 117931
  derived and/or modified sequence opt2 from hemagglutinin__InfluenzaB__AHL91827

SEQ ID NO: 119431 - RNA, 1755 nt, Artificial Sequence; identical to SEQ ID NO: 118538
  derived and/or modified sequence opt2 from hemagglutinin__InfluenzaB__AHL91838

SEQ ID NO: 119432 - RNA, 1755 nt, Artificial Sequence
  derived and/or modified sequence opt2 from hemagglutinin__InfluenzaB__AHL91849
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgaggcccgccccgucaccuccggcugcuuccccaucaugcacgaccgcaccaagauccgccagcuccccaaccuccuccgcggcuacgagaacauccgccucuccacccagaacgucaucgacgccgagaacgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucuccggcuuccccgcccagaccgaggacggcggccucccccaguccggccgcaucgucgucgacuacaugguccagaagccccgcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119433 - RNA, 1755 nt, Artificial Sequence
  derived and/or modified sequence opt2 from hemagglutinin__InfluenzaB__AHL91860
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagauccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacgccauccuccucuacuacuccaccgccgccuccucccucgccgucacccucaugcucgccaucuucaucgucuacauggucucccgcgacaacgucuccugcuccaucugccucuga

SEQ ID NO: 119434 - RNA, 1755 nt, Artificial Sequence
  derived and/or modified sequence opt2 from hemagglutinin__InfluenzaB__AHL91871
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagauccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119435 - RNA, 1755 nt, Artificial Sequence; identical to SEQ ID NO: 117938
  derived and/or modified sequence opt2 from hemagglutinin__InfluenzaB__AHL91882

SEQ ID NO: 119436 - RNA, 1755 nt, Artificial Sequence
  derived and/or modified sequence opt2 from hemagglutinin__InfluenzaB__AHL91904
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcacggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119437 - RNA, 1755 nt, Artificial Sequence
  derived and/or modified sequence opt2 from hemagglutinin__InfluenzaB__AHL91915
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119438 - RNA, 1755 nt, Artificial Sequence; identical to SEQ ID NO: 118536
  derived and/or modified sequence opt2 from hemagglutinin__InfluenzaB__AHL91926

SEQ ID NO: 119439 - RNA, 1755 nt, Artificial Sequence; identical to SEQ ID NO: 119111
  derived and/or modified sequence opt2 from hemagglutinin__InfluenzaB__AHL91937

SEQ ID NO: 119440 - RNA, 1755 nt, Artificial Sequence; identical to SEQ ID NO: 117938
  derived and/or modified sequence opt2 from hemagglutinin__InfluenzaB__AHL91948

SEQ ID NO: 119441 - RNA, 1758 nt, Artificial Sequence
  derived and/or modified sequence opt2 from hemagglutinin__InfluenzaB__AHL91959
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccuccuucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119442 - RNA, 1758 nt, Artificial Sequence; identical to SEQ ID NO: 118150
  derived and/or modified sequence opt2 from hemagglutinin__InfluenzaB__AHL91970

SEQ ID NO: 119443 - RNA, 1755 nt, Artificial Sequence
  derived and/or modified sequence opt2 from hemagglutinin__InfluenzaB__AHL91991
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccaacaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119444 - RNA, 1758 nt, Artificial Sequence; identical to SEQ ID NO: 118026
  derived and/or modified sequence opt2 from hemagglutinin__InfluenzaB__AHL92002

SEQ ID NO: 119445 - RNA, 1758 nt, Artificial Sequence; identical to SEQ ID NO: 118026
  derived and/or modified sequence opt2 from hemagglutinin__InfluenzaB__AHL92013

SEQ ID NO: 119446 - RNA, 1758 nt, Artificial Sequence; identical to SEQ ID NO: 118026
  derived and/or modified sequence opt2 from hemagglutinin__InfluenzaB__AHL92024

SEQ ID NO: 119447 - RNA, 1758 nt, Artificial Sequence; identical to SEQ ID NO: 118026
  derived and/or modified sequence opt2 from hemagglutinin__InfluenzaB__AHL92035

SEQ ID NO: 119448 - RNA, 1758 nt, Artificial Sequence; identical to SEQ ID NO: 118026
  derived and/or modified sequence opt2 from hemagglutinin__InfluenzaB__AHL92046

SEQ ID NO: 119449 - RNA, 1758 nt, Artificial Sequence; identical to SEQ ID NO: 118026
  derived and/or modified sequence opt2 from hemagglutinin__InfluenzaB__AHL92057

SEQ ID NO: 119450 - RNA, 1758 nt, Artificial Sequence
  derived and/or modified sequence opt2 from hemagglutinin__InfluenzaB__AHL92068
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccaggucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119451 - RNA, 1758 nt, Artificial Sequence
  derived and/or modified sequence opt2 from hemagglutinin__InfluenzaB__AHL92079
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119452 - RNA, 1758 nt, Artificial Sequence; identical to SEQ ID NO: 119451
  derived and/or modified sequence opt2 from hemagglutinin__InfluenzaB__AHL92090

SEQ ID NO: 119453 - RNA, 1758 nt, Artificial Sequence; identical to SEQ ID NO: 118026
  derived and/or modified sequence opt2 from hemagglutinin__InfluenzaB__AHL92101

SEQ ID NO: 119454 - RNA, 1755 nt, Artificial Sequence; identical to SEQ ID NO: 118079
  derived and/or modified sequence opt2 from hemagglutinin__InfluenzaB__AHL92112

SEQ ID NO: 119455 - RNA, 1758 nt, Artificial Sequence; identical to SEQ ID NO: 118026
  derived and/or modified sequence opt2 from hemagglutinin__InfluenzaB__AHL92123

SEQ ID NO: 119456 - RNA, 1758 nt, Artificial Sequence; identical to SEQ ID NO: 119451
  derived and/or modified sequence opt2 from hemagglutinin__InfluenzaB__AHL92134

SEQ ID NO: 119457 - RNA, 1758 nt, Artificial Sequence; identical to SEQ ID NO: 119451
  derived and/or modified sequence opt2 from hemagglutinin__InfluenzaB__AHL92145

SEQ ID NO: 119458 - RNA, 1758 nt, Artificial Sequence; identical to SEQ ID NO: 118026
  derived and/or modified sequence opt2 from hemagglutinin__InfluenzaB__AHL92156

SEQ ID NO: 119459 - RNA, 1758 nt, Artificial Sequence; identical to SEQ ID NO: 119451
  derived and/or modified sequence opt2 from hemagglutinin__InfluenzaB__AHL92167

SEQ ID NO: 119460 - RNA, 1758 nt, Artificial Sequence; identical to SEQ ID NO: 118026
  derived and/or modified sequence opt2 from hemagglutinin__InfluenzaB__AHL92178

SEQ ID NO: 119461 - RNA, 1758 nt, Artificial Sequence; identical to SEQ ID NO: 118026
  derived and/or modified sequence opt2 from hemagglutinin__InfluenzaB__AHL92189

SEQ ID NO: 119462 - RNA, 1755 nt, Artificial Sequence; identical to SEQ ID NO: 118079
  derived and/or modified sequence opt2 from hemagglutinin__InfluenzaB__AHL92200

SEQ ID NO: 119463 - RNA, 1758 nt, Artificial Sequence; identical to SEQ ID NO: 118026
  derived and/or modified sequence opt2 from hemagglutinin__InfluenzaB__AHL92211

SEQ ID NO: 119464 - RNA, 1758 nt, Artificial Sequence; identical to SEQ ID NO: 118026
  derived and/or modified sequence opt2 from hemagglutinin__InfluenzaB__AHL92222

SEQ ID NO: 119465 - RNA, 1755 nt, Artificial Sequence; identical to SEQ ID NO: 119341
  derived and/or modified sequence opt2 from hemagglutinin__InfluenzaB__AHL92233

SEQ ID NO: 119466 - RNA, 1758 nt, Artificial Sequence; identical to SEQ ID NO: 119451
  derived and/or modified sequence opt2 from hemagglutinin__InfluenzaB__AHL92244

SEQ ID NO: 119467 - RNA, 1758 nt, Artificial Sequence; identical to SEQ ID NO: 118026
  derived and/or modified sequence opt2 from hemagglutinin__InfluenzaB__AHL92255

SEQ ID NO: 119468 - RNA, 1758 nt, Artificial Sequence; identical to SEQ ID NO: 118026
  derived and/or modified sequence opt2 from hemagglutinin__InfluenzaB__AHL92266

SEQ ID NO: 119469 - RNA, 1758 nt, Artificial Sequence
  derived and/or modified sequence opt2 from hemagglutinin__InfluenzaB__AHL92277
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccaccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119470 - RNA, 1758 nt, Artificial Sequence; identical to SEQ ID NO: 118026
  derived and/or modified sequence opt2 from hemagglutinin__InfluenzaB__AHL92288

SEQ ID NO: 119471 - RNA, 1758 nt, Artificial Sequence; identical to SEQ ID NO: 118026
  derived and/or modified sequence opt2 from hemagglutinin__InfluenzaB__AHL92299

SEQ ID NO: 119472 - RNA, 1755 nt, Artificial Sequence; identical to SEQ ID NO: 119144
  derived and/or modified sequence opt2 from hemagglutinin__InfluenzaB__AHL92310

SEQ ID NO: 119473 - RNA, 1755 nt, Artificial Sequence; identical to SEQ ID NO: 118079
  derived and/or modified sequence opt2 from hemagglutinin__InfluenzaB__AHL92321

SEQ ID NO: 119474 - RNA, 1755 nt, Artificial Sequence; identical to SEQ ID NO: 118079
  derived and/or modified sequence opt2 from hemagglutinin__InfluenzaB__AHL92332

SEQ ID NO: 119475 - RNA, 1755 nt, Artificial Sequence
  derived and/or modified sequence opt2 from hemagglutinin__InfluenzaB__AHL92354
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucgucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119476 - RNA, 1755 nt, Artificial Sequence; identical to SEQ ID NO: 119475
  derived and/or modified sequence opt2 from hemagglutinin__InfluenzaB__AHL92365

SEQ ID NO: 119477 - RNA, 1755 nt, Artificial Sequence; identical to SEQ ID NO: 118332
  derived and/or modified sequence opt2 from hemagglutinin__InfluenzaB__AHL92376

SEQ ID NO: 119478 - RNA, 1755 nt, Artificial Sequence; identical to SEQ ID NO: 118332
  derived and/or modified sequence opt2 from hemagglutinin__InfluenzaB__AHL92387

SEQ ID NO: 119479 - RNA, 1755 nt, Artificial Sequence; identical to SEQ ID NO: 118332
  derived and/or modified sequence opt2 from hemagglutinin__InfluenzaB__AHL92398

SEQ ID NO: 119480 - RNA, 1755 nt, Artificial Sequence; identical to SEQ ID NO: 118332
  derived and/or modified sequence opt2 from hemagglutinin__InfluenzaB__AHL92409

SEQ ID NO: 119481 - RNA, 1755 nt, Artificial Sequence; identical to SEQ ID NO: 118332
  derived and/or modified sequence opt2 from hemagglutinin__InfluenzaB__AHL92420

SEQ ID NO: 119482 - RNA, 1755 nt, Artificial Sequence; identical to SEQ ID NO: 118079
  derived and/or modified sequence opt2 from hemagglutinin__InfluenzaB__AHL92431

SEQ ID NO: 119483 - RNA, 1755 nt, Artificial Sequence; identical to SEQ ID NO: 118332
  derived and/or modified sequence opt2 from hemagglutinin__InfluenzaB__AHL92442

SEQ ID NO: 119484 - RNA, 1755 nt, Artificial Sequence; identical to SEQ ID NO: 118332
  derived and/or modified sequence opt2 from hemagglutinin__InfluenzaB__AHL92453

SEQ ID NO: 119485 - RNA, 1755 nt, Artificial Sequence; identical to SEQ ID NO: 118332
  derived and/or modified sequence opt2 from hemagglutinin__InfluenzaB__AHL92464

SEQ ID NO: 119486 - RNA, 1755 nt, Artificial Sequence
  derived and/or modified sequence opt2 from hemagglutinin__InfluenzaB__AHL92475
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccaggccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119487 - RNA, 1755 nt, Artificial Sequence; identical to SEQ ID NO: 118079
  derived and/or modified sequence opt2 from hemagglutinin__InfluenzaB__AHL92486

SEQ ID NO: 119488 - RNA, 1755 nt, Artificial Sequence; identical to SEQ ID NO: 118332
  derived and/or modified sequence opt2 from hemagglutinin__InfluenzaB__AHL92497

SEQ ID NO: 119489 - RNA, 1755 nt, Artificial Sequence; identical to SEQ ID NO: 118332
  derived and/or modified sequence opt2 from hemagglutinin__InfluenzaB__AHL92508

SEQ ID NO: 119490 - RNA, 1755 nt, Artificial Sequence; identical to SEQ ID NO: 118332
  derived and/or modified sequence opt2 from hemagglutinin__InfluenzaB__AHL92519

SEQ ID NO: 119491 - RNA, 1755 nt, Artificial Sequence; identical to SEQ ID NO: 118332
  derived and/or modified sequence opt2 from hemagglutinin__InfluenzaB__AHL92530

SEQ ID NO: 119492 - RNA, 1755 nt, Artificial Sequence; identical to SEQ ID NO: 118079
  derived and/or modified sequence opt2 from hemagglutinin__InfluenzaB__AHL92541

SEQ ID NO: 119493 - RNA, 1752 nt, Artificial Sequence
  derived and/or modified sequence opt2 from hemagglutinin__InfluenzaB__AHL92563
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaagaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119494 - RNA, 1755 nt, Artificial Sequence; identical to SEQ ID NO: 118332
  derived and/or modified sequence opt2 from hemagglutinin__InfluenzaB__AHL92574

SEQ ID NO: 119495 - RNA, 1755 nt, Artificial Sequence
  derived and/or modified sequence opt2 from hemagglutinin__InfluenzaB__AHL92585
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcgccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119496 - RNA, 1755 nt, Artificial Sequence; identical to SEQ ID NO: 118332
  derived and/or modified sequence opt2 from hemagglutinin__InfluenzaB__AHL92596

SEQ ID NO: 119497 - RNA, 1755 nt, Artificial Sequence; identical to SEQ ID NO: 118079
  derived and/or modified sequence opt2 from hemagglutinin__InfluenzaB__AHL92607

SEQ ID NO: 119498 - RNA, 1755 nt, Artificial Sequence
  derived and/or modified sequence opt2 from hemagglutinin__InfluenzaB__AHL92629
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccgagaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119499 - RNA, 1755 nt, Artificial Sequence; identical to SEQ ID NO: 118079
  derived and/or modified sequence opt2 from hemagglutinin__InfluenzaB__AHL92640

SEQ ID NO: 119500 - RNA, 1755 nt, Artificial Sequence; identical to SEQ ID NO: 118079
  derived and/or modified sequence opt2 from hemagglutinin__InfluenzaB__AHL92651

SEQ ID NO: 119501 - RNA, 1755 nt, Artificial Sequence
  derived and/or modified sequence opt2 from hemagglutinin__InfluenzaB__AHL92684
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaucauccuccucuacuacuccaccgccgccuccucccucgccgucacccucaugcucgccaucuucaucgucuacauggucucccgcgacaacgucuccugcuccaucugccucuga

SEQ ID NO: 119502 - RNA, 1755 nt, Artificial Sequence; identical to SEQ ID NO: 118332
  derived and/or modified sequence opt2 from hemagglutinin__InfluenzaB__AHL92695

SEQ ID NO: 119503 - RNA, 1755 nt, Artificial Sequence; identical to SEQ ID NO: 118332
  derived and/or modified sequence opt2 from hemagglutinin__InfluenzaB__AHL92706

SEQ ID NO: 119504 - RNA, 1755 nt, Artificial Sequence
  derived and/or modified sequence opt2 from hemagglutinin__InfluenzaB__AHL92728
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagaucaucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119505 - RNA, 1755 nt, Artificial Sequence; identical to SEQ ID NO: 119504
  derived and/or modified sequence opt2 from hemagglutinin__InfluenzaB__AHL92739

SEQ ID NO: 119506 - RNA, 1755 nt, Artificial Sequence; identical to SEQ ID NO: 119504
  derived and/or modified sequence opt2 from hemagglutinin__InfluenzaB__AHL92750

SEQ ID NO: 119507 - RNA, 1755 nt, Artificial Sequence; identical to SEQ ID NO: 118332
  derived and/or modified sequence opt2 from hemagglutinin__InfluenzaB__AHL92761

SEQ ID NO: 119508 - RNA, 1755 nt, Artificial Sequence
  derived and/or modified sequence opt2 from hemagglutinin__InfluenzaB__AHL92772
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcaugggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119509 - RNA, 1755 nt, Artificial Sequence; identical to SEQ ID NO: 118332
  derived and/or modified sequence opt2 from hemagglutinin__InfluenzaB__AHL92794

SEQ ID NO: 119510 - RNA, 1755 nt, Artificial Sequence; identical to SEQ ID NO: 118332
  derived and/or modified sequence opt2 from hemagglutinin__InfluenzaB__AHL92805

SEQ ID NO: 119511 - RNA, 1755 nt, Artificial Sequence; identical to SEQ ID NO: 118332
  derived and/or modified sequence opt2 from hemagglutinin__InfluenzaB__AHL92816

SEQ ID NO: 119512 - RNA, 1755 nt, Artificial Sequence
  derived and/or modified sequence opt2 from hemagglutinin__InfluenzaB__AHL92827
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucgucgucuacauggucucccgcgacaacgucuccugcuccaucugccucuga

SEQ ID NO: 119513 - RNA, 1755 nt, Artificial Sequence; identical to SEQ ID NO: 118332
  derived and/or modified sequence opt2 from hemagglutinin__InfluenzaB__AHL92838

SEQ ID NO: 119514 - RNA, 1755 nt, Artificial Sequence; identical to SEQ ID NO: 118332
  derived and/or modified sequence opt2 from hemagglutinin__InfluenzaB__AHL92849

SEQ ID NO: 119515 - RNA, 1755 nt, Artificial Sequence; identical to SEQ ID NO: 118332
  derived and/or modified sequence opt2 from hemagglutinin__InfluenzaB__AHL92860

SEQ ID NO: 119516 - RNA, 1758 nt, Artificial Sequence; identical to SEQ ID NO: 118150
  derived and/or modified sequence opt2 from hemagglutinin__InfluenzaB__AHL92871

SEQ ID NO: 119517 - RNA, 1755 nt, Artificial Sequence; identical to SEQ ID NO: 117938
  derived and/or modified sequence opt2 from hemagglutinin__InfluenzaB__AHL92882

SEQ ID NO: 119518 - RNA, 1758 nt, Artificial Sequence
  derived and/or modified sequence opt2 from hemagglutinin__InfluenzaB__AHL92893
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaaggagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119519 - RNA, 1755 nt, Artificial Sequence; identical to SEQ ID NO: 118535
  derived and/or modified sequence opt2 from hemagglutinin__InfluenzaB__AHL92904

SEQ ID NO: 119520 - RNA, 1758 nt, Artificial Sequence
  derived and/or modified sequence opt2 from hemagglutinin__InfluenzaB__AHL92915
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaacauccccuccgccgaggucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaaggcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 119521 - RNA, 1758 nt, Artificial Sequence; identical to SEQ ID NO: 118150
  derived and/or modified sequence opt2 from hemagglutinin__InfluenzaB__AHL92926

SEQ ID NO: 119522 - RNA, 1755 nt, Artificial Sequence; identical to SEQ ID NO: 119111
  derived and/or modified sequence opt2 from hemagglutinin__InfluenzaB__AHL92937

SEQ ID NO: 119523 - RNA, 1758 nt, Artificial Sequence; identical to SEQ ID NO: 118026
  derived and/or modified sequence opt2 from hemagglutinin__InfluenzaB__AHL92948

SEQ ID NO: 119524 - RNA, 1758 nt, Artificial Sequence; identical to SEQ ID NO: 118026
  derived and/or modified sequence opt2 from hemagglutinin__InfluenzaB__AHL92959

SEQ ID NO: 119525 - RNA, 1758 nt, Artificial Sequence; identical to SEQ ID NO: 118026
  derived and/or modified sequence opt2 from hemagglutinin__InfluenzaB__AHL92970

SEQ ID NO: 119526 - RNA, 1758 nt, Artificial Sequence; identical to SEQ ID NO: 118026
  derived and/or modified sequence opt2 from hemagglutinin__InfluenzaB__AHL92981

SEQ ID NO: 119527 - RNA, 1758 nt, Artificial Sequence; identical to SEQ ID NO: 118026
  derived and/or modified sequence opt2 from hemagglutinin__InfluenzaB__AHL92992

SEQ ID NO: 119528 - RNA, 1758 nt, Artificial Sequence; identical to SEQ ID NO: 119451
  derived and/or modified sequence opt2 from hemagglutinin__InfluenzaB__AHL93004

SEQ ID NO: 119529 - RNA, 1758 nt, Artificial Sequence; identical to SEQ ID NO: 118026
  derived and/or modified sequence opt2 from hemagglutinin__InfluenzaB__AHL93015

SEQ ID NO: 119530 - RNA, 1758 nt, Artificial Sequence; identical to SEQ ID NO: 118026
  derived and/or modified sequence opt2 from hemagglutinin__InfluenzaB__AHL93026

SEQ ID NO: 119531 - RNA, 1755 nt, Artificial Sequence; identical to SEQ ID NO: 119475
  derived and/or modified sequence opt2 from hemagglutinin__InfluenzaB__AHL93037

SEQ ID NO: 119532 - RNA, 1755 nt, Artificial Sequence; identical to SEQ ID NO: 119475
  derived and/or modified sequence opt2 from hemagglutinin__InfluenzaB__AHL93048

SEQ ID NO: 119533 - RNA, 1755 nt, Artificial Sequence; identical to SEQ ID NO: 119504
  derived and/or modified sequence opt2 from hemagglutinin__InfluenzaB__AHL93059

SEQ ID NO: 119534 - RNA, 1755 nt, Artificial Sequence; identical to SEQ ID NO: 118332
  derived and/or modified sequence opt2 from hemagglutinin__InfluenzaB__AHL93070

SEQ ID NO: 119535 - RNA, 1755 nt, Artificial Sequence
  derived and/or modified sequence opt2 from hemagglutinin__InfluenzaB__AHL93081
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacggcaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119536 - RNA, 1755 nt, Artificial Sequence; identical to SEQ ID NO: 118332
  derived and/or modified sequence opt2 from hemagglutinin__InfluenzaB__AHL93092

SEQ ID NO: 119537 - RNA, 1755 nt, Artificial Sequence; identical to SEQ ID NO: 118332
  derived and/or modified sequence opt2 from hemagglutinin__InfluenzaB__AHL93103

SEQ ID NO: 119538 - RNA, 1755 nt, Artificial Sequence; identical to SEQ ID NO: 118332
  derived and/or modified sequence opt2 from hemagglutinin__InfluenzaB__AHL93114

SEQ ID NO: 119539 - RNA, 1755 nt, Artificial Sequence; identical to SEQ ID NO: 118079
  derived and/or modified sequence opt2 from hemagglutinin__InfluenzaB__AHL93125

SEQ ID NO: 119540 - RNA, 1755 nt, Artificial Sequence
  derived and/or modified sequence opt2 from hemagglutinin__InfluenzaB__AHL93136
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119541 - RNA, 1755 nt, Artificial Sequence; identical to SEQ ID NO: 118079
  derived and/or modified sequence opt2 from hemagglutinin__InfluenzaB__AHL93147

SEQ ID NO: 119542 - RNA, 1755 nt, Artificial Sequence; identical to SEQ ID NO: 118332
  derived and/or modified sequence opt2 from hemagglutinin__InfluenzaB__AHL93158

SEQ ID NO: 119543 - RNA, 1755 nt, Artificial Sequence
  derived and/or modified sequence opt2 from hemagglutinin__InfluenzaB__AHL93169
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugcuucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119544 - RNA, 1755 nt, Artificial Sequence
  derived and/or modified sequence opt2 from hemagglutinin__InfluenzaB__AHL93180
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucauccacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119545 - RNA, 1755 nt, Artificial Sequence
  derived and/or modified sequence opt2 from hemagglutinin__InfluenzaB__AHL93191
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgacaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119546 - RNA, 1755 nt, Artificial Sequence
  derived and/or modified sequence opt2 from hemagglutinin__InfluenzaB__AHL93202
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgaguuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119547 - RNA, 1758 nt, Artificial Sequence; identical to SEQ ID NO: 118501
  derived and/or modified sequence opt2 from hemagglutinin__InfluenzaB__AHL93213

SEQ ID NO: 119548 - RNA, 1758 nt, Artificial Sequence; identical to SEQ ID NO: 118501
  derived and/or modified sequence opt2 from hemagglutinin__InfluenzaB__AHL93224

SEQ ID NO: 119549 - RNA, 1758 nt, Artificial Sequence
  derived and/or modified sequence opt2 from hemagglutinin__InfluenzaB__AHL93235
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacaacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119550 - RNA, 1758 nt, Artificial Sequence
  derived and/or modified sequence opt2 from hemagglutinin__InfluenzaB__AHL93246
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacucccucaccaucgagguccccuacaucugcaccgagggcgaggaccagaucaccaucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucggcgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119551 - RNA, 1758 nt, Artificial Sequence; identical to SEQ ID NO: 118501
  derived and/or modified sequence opt2 from hemagglutinin__InfluenzaB__AHL93257

SEQ ID NO: 119552 - RNA, 1758 nt, Artificial Sequence; identical to SEQ ID NO: 118834
  derived and/or modified sequence opt2 from hemagglutinin__InfluenzaB__AHL93268

SEQ ID NO: 119553 - RNA, 1758 nt, Artificial Sequence
  derived and/or modified sequence opt2 from hemagglutinin__InfluenzaB__AHL93279
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggcaaguccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119554 - RNA, 1758 nt, Artificial Sequence; identical to SEQ ID NO: 118501
  derived and/or modified sequence opt2 from hemagglutinin__InfluenzaB__AHL93290

SEQ ID NO: 119555 - RNA, 1758 nt, Artificial Sequence
  derived and/or modified sequence opt2 from hemagglutinin__InfluenzaB__AHL93301
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119556 - RNA, 1758 nt, Artificial Sequence
  derived and/or modified sequence opt2 from hemagglutinin__InfluenzaB__AHL93312
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuacgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119557 - RNA, 1758 nt, Artificial Sequence
  derived and/or modified sequence opt2 from hemagglutinin__InfluenzaB__AHL93323
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119558 - RNA, 1758 nt, Artificial Sequence
  derived and/or modified sequence opt2 from hemagglutinin__InfluenzaB__AHL93334
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119559 - RNA, 1758 nt, Artificial Sequence; identical to SEQ ID NO: 118501
  derived and/or modified sequence opt2 from hemagglutinin__InfluenzaB__AHL93345

SEQ ID NO: 119560 - RNA, 1758 nt, Artificial Sequence; identical to SEQ ID NO: 118501
  derived and/or modified sequence opt2 from hemagglutinin__InfluenzaB__AHL93356

SEQ ID NO: 119561 - RNA, 1758 nt, Artificial Sequence
  derived and/or modified sequence opt2 from hemagglutinin__InfluenzaB__AHL93367
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgaguacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119562 - RNA, 1758 nt, Artificial Sequence; identical to SEQ ID NO: 118501
  derived and/or modified sequence opt2 from hemagglutinin__InfluenzaB__AHL93378

SEQ ID NO: 119563 - RNA, 1758 nt, Artificial Sequence
  derived and/or modified sequence opt2 from hemagglutinin__InfluenzaB__AHL93389
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119564 - RNA, 1758 nt, Artificial Sequence; identical to SEQ ID NO: 118501
  derived and/or modified sequence opt2 from hemagglutinin__InfluenzaB__AHL93400

SEQ ID NO: 119565 - RNA, 1758 nt, Artificial Sequence; identical to SEQ ID NO: 118834
  derived and/or modified sequence opt2 from hemagglutinin__InfluenzaB__AHL93411

SEQ ID NO: 119566 - RNA, 1758 nt, Artificial Sequence; identical to SEQ ID NO: 118834
  derived and/or modified sequence opt2 from hemagglutinin__InfluenzaB__AHL93422

SEQ ID NO: 119567 - RNA, 1758 nt, Artificial Sequence; identical to SEQ ID NO: 118834
  derived and/or modified sequence opt2 from hemagglutinin__InfluenzaB__AHL93433

SEQ ID NO: 119568 - RNA, 1758 nt, Artificial Sequence; identical to SEQ ID NO: 118501
  derived and/or modified sequence opt2 from hemagglutinin__InfluenzaB__AHL93444

SEQ ID NO: 119569 - RNA, 1758 nt, Artificial Sequence
  derived and/or modified sequence opt2 from hemagglutinin__InfluenzaB__AHL93455
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccaugaacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119570 - RNA, 1758 nt, Artificial Sequence; identical to SEQ ID NO: 118501
  derived and/or modified sequence opt2 from hemagglutinin__InfluenzaB__AHL93466

SEQ ID NO: 119571 - RNA, 1758 nt, Artificial Sequence; identical to SEQ ID NO: 118120
  derived and/or modified sequence opt2 from hemagglutinin__InfluenzaB__AHL93477

SEQ ID NO: 119572 - RNA, 1758 nt, Artificial Sequence; identical to SEQ ID NO: 118195
  derived and/or modified sequence opt2 from hemagglutinin__InfluenzaB__AHL93488

SEQ ID NO: 119573 - RNA, 1755 nt, Artificial Sequence
  derived and/or modified sequence opt2 from hemagglutinin__InfluenzaB__AHL93499
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagauccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccgcccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119574 - RNA, 1758 nt, Artificial Sequence; identical to SEQ ID NO: 118120
  derived and/or modified sequence opt2 from hemagglutinin__InfluenzaB__AHL93510

SEQ ID NO: 119575 - RNA, 1755 nt, Artificial Sequence
  derived and/or modified sequence opt2 from hemagglutinin__InfluenzaB__AHL93521
augaaggccaucaucgcccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagcgcuucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119576 - RNA, 1758 nt, Artificial Sequence; identical to SEQ ID NO: 118195
  derived and/or modified sequence opt2 from hemagglutinin__InfluenzaB__AHL93532

SEQ ID NO: 119577 - RNA, 1758 nt, Artificial Sequence; identical to SEQ ID NO: 118157
  derived and/or modified sequence opt2 from hemagglutinin__InfluenzaB__AHL93543

SEQ ID NO: 119578 - RNA, 1758 nt, Artificial Sequence; identical to SEQ ID NO: 118157
  derived and/or modified sequence opt2 from hemagglutinin__InfluenzaB__AHL93554

SEQ ID NO: 119579 - RNA, 1758 nt, Artificial Sequence; identical to SEQ ID NO: 118157
  derived and/or modified sequence opt2 from hemagglutinin__InfluenzaB__AHL93565

SEQ ID NO: 119580 - RNA, 1758 nt, Artificial Sequence; identical to SEQ ID NO: 118195
  derived and/or modified sequence opt2 from hemagglutinin__InfluenzaB__AHL93576

SEQ ID NO: 119581 - RNA, 1758 nt, Artificial Sequence; identical to SEQ ID NO: 118195
  derived and/or modified sequence opt2 from hemagglutinin__InfluenzaB__AHL93587

SEQ ID NO: 119582 - RNA, 1758 nt, Artificial Sequence
  derived and/or modified sequence opt2 from hemagglutinin__InfluenzaB__AHL93609
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaccgagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119583 - RNA, 1758 nt, Artificial Sequence; identical to SEQ ID NO: 118195
  derived and/or modified sequence opt2 from hemagglutinin__InfluenzaB__AHL93620

SEQ ID NO: 119584 - RNA, 1758 nt, Artificial Sequence; identical to SEQ ID NO: 119582
  derived and/or modified sequence opt2 from hemagglutinin__InfluenzaB__AHL93631

SEQ ID NO: 119585 - RNA, 1758 nt, Artificial Sequence; identical to SEQ ID NO: 119582
  derived and/or modified sequence opt2 from hemagglutinin__InfluenzaB__AHL93642

SEQ ID NO: 119586 - RNA, 1755 nt, Artificial Sequence
  derived and/or modified sequence opt2 from hemagglutinin__InfluenzaB__AHL93653
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcgacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119587 - RNA, 1758 nt, Artificial Sequence; identical to SEQ ID NO: 118195
  derived and/or modified sequence opt2 from hemagglutinin__InfluenzaB__AHL93664

SEQ ID NO: 119588 - RNA, 1758 nt, Artificial Sequence; identical to SEQ ID NO: 118120
  derived and/or modified sequence opt2 from hemagglutinin__InfluenzaB__AHL93675

SEQ ID NO: 119589 - RNA, 1758 nt, Artificial Sequence; identical to SEQ ID NO: 119582
  derived and/or modified sequence opt2 from hemagglutinin__InfluenzaB__AHL93686

SEQ ID NO: 119590 - RNA, 1758 nt, Artificial Sequence; identical to SEQ ID NO: 119582
  derived and/or modified sequence opt2 from hemagglutinin__InfluenzaB__AHL93697

SEQ ID NO: 119591 - RNA, 1758 nt, Artificial Sequence
  derived and/or modified sequence opt2 from hemagglutinin__InfluenzaB__AHL93708
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcaagcacgccaaggccaucggcaacugccccaucugggucaagaccccccucaagcucgccaacggcaccaaguaccgcccccccgccaagcuccucaccgagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119592 - RNA, 1758 nt, Artificial Sequence
  derived and/or modified sequence opt2 from hemagglutinin__InfluenzaB__AHL93719
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgaggucauccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119593 - RNA, 1758 nt, Artificial Sequence; identical to SEQ ID NO: 118195
  derived and/or modified sequence opt2 from hemagglutinin__InfluenzaB__AHL93730

SEQ ID NO: 119594 - RNA, 1758 nt, Artificial Sequence; identical to SEQ ID NO: 118195
  derived and/or modified sequence opt2 from hemagglutinin__InfluenzaB__AHL93741

SEQ ID NO: 119595 - RNA, 1758 nt, Artificial Sequence; identical to SEQ ID NO: 118157
  derived and/or modified sequence opt2 from hemagglutinin__InfluenzaB__AHL93752

SEQ ID NO: 119596 - RNA, 1758 nt, Artificial Sequence; identical to SEQ ID NO: 119582
  derived and/or modified sequence opt2 from hemagglutinin__InfluenzaB__AHL93763

SEQ ID NO: 119597 - RNA, 1758 nt, Artificial Sequence; identical to SEQ ID NO: 118120
  derived and/or modified sequence opt2 from hemagglutinin__InfluenzaB__AHL93774

SEQ ID NO: 119598 - RNA, 1758 nt, Artificial Sequence; identical to SEQ ID NO: 119582
  derived and/or modified sequence opt2 from hemagglutinin__InfluenzaB__AHL93785

SEQ ID NO: 119599 - RNA, 1758 nt, Artificial Sequence; identical to SEQ ID NO: 118195
  derived and/or modified sequence opt2 from hemagglutinin__InfluenzaB__AHL93796

SEQ ID NO: 119600 - RNA, 1758 nt, Artificial Sequence; identical to SEQ ID NO: 118120
  derived and/or modified sequence opt2 from hemagglutinin__InfluenzaB__AHL93818

SEQ ID NO: 119601 - RNA, 1758 nt, Artificial Sequence
  derived and/or modified sequence opt2 from hemagglutinin__InfluenzaB__AHL93829
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacaccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119602 - RNA, 1758 nt, Artificial Sequence; identical to SEQ ID NO: 118501
  derived and/or modified sequence opt2 from hemagglutinin__InfluenzaB__AHL93840

SEQ ID NO: 119603 - RNA, 1758 nt, Artificial Sequence; identical to SEQ ID NO: 118195
  derived and/or modified sequence opt2 from hemagglutinin__InfluenzaB__AHL93851

SEQ ID NO: 119604 - RNA, 1758 nt, Artificial Sequence; identical to SEQ ID NO: 118195
  derived and/or modified sequence opt2 from hemagglutinin__InfluenzaB__AHL93862

SEQ ID NO: 119605 - RNA, 1758 nt, Artificial Sequence
  derived and/or modified sequence opt2 from hemagglutinin__InfluenzaB__AHL93873
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcgagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119606 - RNA, 1758 nt, Artificial Sequence; identical to SEQ ID NO: 118195
  derived and/or modified sequence opt2 from hemagglutinin__InfluenzaB__AHL93884

SEQ ID NO: 119607 - RNA, 1758 nt, Artificial Sequence; identical to SEQ ID NO: 118195
  derived and/or modified sequence opt2 from hemagglutinin__InfluenzaB__AHL93895

SEQ ID NO: 119608 - RNA, 1758 nt, Artificial Sequence; identical to SEQ ID NO: 118195
  derived and/or modified sequence opt2 from hemagglutinin__InfluenzaB__AHL93906

SEQ ID NO: 119609 - RNA, 1758 nt, Artificial Sequence; identical to SEQ ID NO: 118195
  derived and/or modified sequence opt2 from hemagglutinin__InfluenzaB__AHL93917

SEQ ID NO: 119610 - RNA, 1758 nt, Artificial Sequence; identical to SEQ ID NO: 118120
  derived and/or modified sequence opt2 from hemagglutinin__InfluenzaB__AHL93928

SEQ ID NO: 119611 - RNA, 1758 nt, Artificial Sequence; identical to SEQ ID NO: 118157
  derived and/or modified sequence opt2 from hemagglutinin__InfluenzaB__AHL93939

SEQ ID NO: 119612 - RNA, 1758 nt, Artificial Sequence; identical to SEQ ID NO: 118195
  derived and/or modified sequence opt2 from hemagglutinin__InfluenzaB__AHL93950

SEQ ID NO: 119613 - RNA, 1758 nt, Artificial Sequence; identical to SEQ ID NO: 118157
  derived and/or modified sequence opt2 from hemagglutinin__InfluenzaB__AHL93961

SEQ ID NO: 119614 - RNA, 1758 nt, Artificial Sequence
  derived and/or modified sequence opt2 from hemagglutinin__InfluenzaB__AHL93972
augaaggccaucaucguccuccucauggucgucaccuccaccgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccgucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119615 - RNA, 1758 nt, Artificial Sequence; identical to SEQ ID NO: 118120
  derived and/or modified sequence opt2 from hemagglutinin__InfluenzaB__AHL93983

SEQ ID NO: 119616 - RNA, 1755 nt, Artificial Sequence
  derived and/or modified sequence opt2 from hemagglutinin__InfluenzaB__AHL93994
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaagaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacaugaucucccgcgacaacgucuccugcuccaucugccucuga

SEQ ID NO: 119617 - RNA, 1758 nt, Artificial Sequence; identical to SEQ ID NO: 118195
  derived and/or modified sequence opt2 from hemagglutinin__InfluenzaB__AHL94005

SEQ ID NO: 119618 - RNA, 1758 nt, Artificial Sequence; identical to SEQ ID NO: 118195
  derived and/or modified sequence opt2 from hemagglutinin__InfluenzaB__AHL94016

SEQ ID NO: 119619 - RNA, 1758 nt, Artificial Sequence
  derived and/or modified sequence opt2 from hemagglutinin__InfluenzaB__AHL94027
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagaugggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119620 - RNA, 1758 nt, Artificial Sequence; identical to SEQ ID NO: 118157
  derived and/or modified sequence opt2 from hemagglutinin__InfluenzaB__AHL94038

SEQ ID NO: 119621 - RNA, 1758 nt, Artificial Sequence; identical to SEQ ID NO: 118120
  derived and/or modified sequence opt2 from hemagglutinin__InfluenzaB__AHL94049

SEQ ID NO: 119622 - RNA, 1758 nt, Artificial Sequence; identical to SEQ ID NO: 118195
  derived and/or modified sequence opt2 from hemagglutinin__InfluenzaB__AHL94060

SEQ ID NO: 119623 - RNA, 1758 nt, Artificial Sequence
  derived and/or modified sequence opt2 from hemagglutinin__InfluenzaB__AHL94071
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugaugcagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucuccaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119624 - RNA, 1755 nt, Artificial Sequence
  derived and/or modified sequence opt2 from hemagglutinin__InfluenzaB__AHL94082
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagauccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119625 - RNA, 1758 nt, Artificial Sequence; identical to SEQ ID NO: 118157
  derived and/or modified sequence opt2 from hemagglutinin__InfluenzaB__AHL94093

SEQ ID NO: 119626 - RNA, 1758 nt, Artificial Sequence; identical to SEQ ID NO: 118195
  derived and/or modified sequence opt2 from hemagglutinin__InfluenzaB__AHL94102

SEQ ID NO: 119627 - RNA, 1758 nt, Artificial Sequence
  derived and/or modified sequence opt2 from hemagglutinin__InfluenzaB__AHL94113
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccucaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119628 - RNA, 1758 nt, Artificial Sequence
  derived and/or modified sequence opt2 from hemagglutinin__InfluenzaB__AHL94124
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagauccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119629 - RNA, 1758 nt, Artificial Sequence; identical to SEQ ID NO: 118120
  derived and/or modified sequence opt2 from hemagglutinin__InfluenzaB__AHL94135

SEQ ID NO: 119630 - RNA, 1758 nt, Artificial Sequence; identical to SEQ ID NO: 118120
  derived and/or modified sequence opt2 from hemagglutinin__InfluenzaB__AHL94146

SEQ ID NO: 119631 - RNA, 1758 nt, Artificial Sequence; identical to SEQ ID NO: 118195
  derived and/or modified sequence opt2 from hemagglutinin__InfluenzaB__AHL94157

SEQ ID NO: 119632 - RNA, 1758 nt, Artificial Sequence; identical to SEQ ID NO: 118195
  derived and/or modified sequence opt2 from hemagglutinin__InfluenzaB__AHL94168

SEQ ID NO: 119633 - RNA, 1758 nt, Artificial Sequence; identical to SEQ ID NO: 118120
  derived and/or modified sequence opt2 from hemagglutinin__InfluenzaB__AHL94179

SEQ ID NO: 119634 - RNA, 1758 nt, Artificial Sequence; identical to SEQ ID NO: 118120
  derived and/or modified sequence opt2 from hemagglutinin__InfluenzaB__AHL94190

SEQ ID NO: 119635 - RNA, 1758 nt, Artificial Sequence
  derived and/or modified sequence opt2 from hemagglutinin__InfluenzaB__AHL94201
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgagaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcaacaacgucuccugcuccaucugccucuga

SEQ ID NO: 119636 - RNA, 1758 nt, Artificial Sequence
  derived and/or modified sequence opt2 from hemagglutinin__InfluenzaB__AHL94212
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccaggucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119637 - RNA, 1758 nt, Artificial Sequence; identical to SEQ ID NO: 118195
  derived and/or modified sequence opt2 from hemagglutinin__InfluenzaB__AHL94220

SEQ ID NO: 119638 - RNA, 1758 nt, Artificial Sequence; identical to SEQ ID NO: 118195
  derived and/or modified sequence opt2 from hemagglutinin__InfluenzaB__AHL94231

SEQ ID NO: 119639 - RNA, 1758 nt, Artificial Sequence
  derived and/or modified sequence opt2 from hemagglutinin__InfluenzaB__AHL94242
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccaacggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119640 - RNA, 1758 nt, Artificial Sequence; identical to SEQ ID NO: 118157
  derived and/or modified sequence opt2 from hemagglutinin__InfluenzaB__AHL94253

SEQ ID NO: 119641 - RNA, 1755 nt, Artificial Sequence
  derived and/or modified sequence opt2 from hemagglutinin__InfluenzaB__AHL94274
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119642 - RNA, 1755 nt, Artificial Sequence; identical to SEQ ID NO: 119641
  derived and/or modified sequence opt2 from hemagglutinin__InfluenzaB__AHL94295

SEQ ID NO: 119643 - RNA, 1755 nt, Artificial Sequence
  derived and/or modified sequence opt2 from hemagglutinin__InfluenzaB__AHL94306
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119644 - RNA, 1755 nt, Artificial Sequence
  derived and/or modified sequence opt2 from hemagglutinin__InfluenzaB__AHL94317
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcauccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccgucccccgcgacaacuacaagaacgccaccaacccccagaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119645 - RNA, 1755 nt, Artificial Sequence; identical to SEQ ID NO: 119643
  derived and/or modified sequence opt2 from hemagglutinin__InfluenzaB__AHL94328

SEQ ID NO: 119646 - RNA, 1755 nt, Artificial Sequence; identical to SEQ ID NO: 119641
  derived and/or modified sequence opt2 from hemagglutinin__InfluenzaB__AHL94339

SEQ ID NO: 119647 - RNA, 1758 nt, Artificial Sequence
  derived and/or modified sequence opt2 from hemagglutinin__InfluenzaB__AHL94350
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucuccaaggacaacgucuccugcuccaucugccucuga

SEQ ID NO: 119648 - RNA, 1758 nt, Artificial Sequence
  derived and/or modified sequence opt2 from hemagglutinin__InfluenzaB__AHL94361
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucgccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacuccgucuccugcuccaucugccucuga

SEQ ID NO: 119649 - RNA, 1758 nt, Artificial Sequence
  derived and/or modified sequence opt2 from hemagglutinin__InfluenzaB__AHL94383
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggagaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119650 - RNA, 1758 nt, Artificial Sequence; identical to SEQ ID NO: 118157
  derived and/or modified sequence opt2 from hemagglutinin__InfluenzaB__AHL94394

SEQ ID NO: 119651 - RNA, 1758 nt, Artificial Sequence
  derived and/or modified sequence opt2 from hemagglutinin__InfluenzaB__AHL94405
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119652 - RNA, 1758 nt, Artificial Sequence; identical to SEQ ID NO: 118157
  derived and/or modified sequence opt2 from hemagglutinin__InfluenzaB__AHL94416

SEQ ID NO: 119653 - RNA, 1755 nt, Artificial Sequence; identical to SEQ ID NO: 118366
  derived and/or modified sequence opt2 from hemagglutinin__InfluenzaB__AHL94427

SEQ ID NO: 119654 - RNA, 1755 nt, Artificial Sequence
  derived and/or modified sequence opt2 from hemagglutinin__InfluenzaB__AHL94438
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgagaccauggccugggccguccccaaggacaacuacaagaacgccaccaacccccagaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119655 - RNA, 1755 nt, Artificial Sequence
  derived and/or modified sequence opt2 from hemagglutinin__InfluenzaB__AHL94460
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgaggaggaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119656 - RNA, 1755 nt, Artificial Sequence
  derived and/or modified sequence opt2 from hemagglutinin__InfluenzaB__AHL94471
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacaucuccugcuccaucugccucuga

SEQ ID NO: 119657 - RNA, 1758 nt, Artificial Sequence
  derived and/or modified sequence opt2 from hemagglutinin__InfluenzaB__AHL94482
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucaccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119658 - RNA, 1755 nt, Artificial Sequence; identical to SEQ ID NO: 119641
  derived and/or modified sequence opt2 from hemagglutinin__InfluenzaB__AHL94493

SEQ ID NO: 119659 - RNA, 1755 nt, Artificial Sequence; identical to SEQ ID NO: 119643
  derived and/or modified sequence opt2 from hemagglutinin__InfluenzaB__AHL94504

SEQ ID NO: 119660 - RNA, 1758 nt, Artificial Sequence
  derived and/or modified sequence opt2 from hemagglutinin__InfluenzaB__AHL94515
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccaccuacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggagaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119661 - RNA, 1755 nt, Artificial Sequence; identical to SEQ ID NO: 119643
  derived and/or modified sequence opt2 from hemagglutinin__InfluenzaB__AHL94526

SEQ ID NO: 119662 - RNA, 1758 nt, Artificial Sequence
  derived and/or modified sequence opt2 from hemagglutinin__InfluenzaB__AHL94537
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacaucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119663 - RNA, 1755 nt, Artificial Sequence
  derived and/or modified sequence opt2 from hemagglutinin__InfluenzaB__AHL94548
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaucaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagcgcgcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119664 - RNA, 1755 nt, Artificial Sequence; identical to SEQ ID NO: 119641
  derived and/or modified sequence opt2 from hemagglutinin__InfluenzaB__AHL94559

SEQ ID NO: 119665 - RNA, 1755 nt, Artificial Sequence; identical to SEQ ID NO: 118366
  derived and/or modified sequence opt2 from hemagglutinin__InfluenzaB__AHL94570

SEQ ID NO: 119666 - RNA, 1755 nt, Artificial Sequence; identical to SEQ ID NO: 118366
  derived and/or modified sequence opt2 from hemagglutinin__InfluenzaB__AHL94581

SEQ ID NO: 119667 - RNA, 1755 nt, Artificial Sequence; identical to SEQ ID NO: 118366
  derived and/or modified sequence opt2 from hemagglutinin__InfluenzaB__AHL94592

SEQ ID NO: 119668 - RNA, 1758 nt, Artificial Sequence
  derived and/or modified sequence opt2 from hemagglutinin__InfluenzaB__AHL94603
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagaacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119669 - RNA, 1758 nt, Artificial Sequence
  derived and/or modified sequence opt2 from hemagglutinin__InfluenzaB__AHL94614
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaucucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119670 - RNA, 1755 nt, Artificial Sequence; identical to SEQ ID NO: 119643
  derived and/or modified sequence opt2 from hemagglutinin__InfluenzaB__AHL94624

SEQ ID NO: 119671 - RNA, 1758 nt, Artificial Sequence
  derived and/or modified sequence opt2 from hemagglutinin__InfluenzaB__AHL94646
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccucaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119672 - RNA, 1758 nt, Artificial Sequence
  derived and/or modified sequence opt2 from hemagglutinin__InfluenzaB__AHL94657
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaguccgcccccggcggccccuacaagaucggcaccuccggcuccugccccaacgucaccaacggcaacggcuucuucgccaccauggccugggccguccccaagaacgacaagaacaagaccgccaccgacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119673 - RNA, 1755 nt, Artificial Sequence; identical to SEQ ID NO: 119643
  derived and/or modified sequence opt2 from hemagglutinin__InfluenzaB__AHL94668

SEQ ID NO: 119674 - RNA, 1755 nt, Artificial Sequence; identical to SEQ ID NO: 119643
  derived and/or modified sequence opt2 from hemagglutinin__InfluenzaB__AHL94679

SEQ ID NO: 119675 - RNA, 1758 nt, Artificial Sequence; identical to SEQ ID NO: 119668
  derived and/or modified sequence opt2 from hemagglutinin__InfluenzaB__AHL94690

SEQ ID NO: 119676 - RNA, 1758 nt, Artificial Sequence
  derived and/or modified sequence opt2 from hemagglutinin__InfluenzaB__AHL94701
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccucaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccucaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119677 - RNA, 1755 nt, Artificial Sequence; identical to SEQ ID NO: 119641
  derived and/or modified sequence opt2 from hemagglutinin__InfluenzaB__AHL94712

SEQ ID NO: 119678 - RNA, 1758 nt, Artificial Sequence; identical to SEQ ID NO: 119672
  derived and/or modified sequence opt2 from hemagglutinin__InfluenzaB__AHL94723

SEQ ID NO: 119679 - RNA, 1755 nt, Artificial Sequence; identical to SEQ ID NO: 119641
  derived and/or modified sequence opt2 from hemagglutinin__InfluenzaB__AHL94734

SEQ ID NO: 119680 - RNA, 1758 nt, Artificial Sequence
  derived and/or modified sequence opt2 from hemagglutinin__InfluenzaB__AHL94745
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccucaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacggcgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119681 - RNA, 1755 nt, Artificial Sequence; identical to SEQ ID NO: 118366
  derived and/or modified sequence opt2 from hemagglutinin__InfluenzaB__AHL94756

SEQ ID NO: 119682 - RNA, 1758 nt, Artificial Sequence; identical to SEQ ID NO: 119671
  derived and/or modified sequence opt2 from hemagglutinin__InfluenzaB__AHL94766

SEQ ID NO: 119683 - RNA, 1755 nt, Artificial Sequence
  derived and/or modified sequence opt2 from hemagglutinin__InfluenzaB__AHL94777
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcacccgcacccgcggcaagcucugccccgacugcuucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgccaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119684 - RNA, 1758 nt, Artificial Sequence; identical to SEQ ID NO: 119668
  derived and/or modified sequence opt2 from hemagglutinin__InfluenzaB__AHL94797

SEQ ID NO: 119685 - RNA, 1755 nt, Artificial Sequence
  derived and/or modified sequence opt2 from hemagglutinin__InfluenzaB__AHL94808
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcauccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119686 - RNA, 1755 nt, Artificial Sequence
  derived and/or modified sequence opt2 from hemagglutinin__InfluenzaB__AHL94817
augaaggccaucaucguccuccucauggucgucaccuccaacgccgaccgcaucugcaccggcaucaccuccuccaacuccccccacgucgucaagaccgccacccagggcgaggucaacgucaccggcgccaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagaucaucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119687 - RNA, 1758 nt, Artificial Sequence; identical to SEQ ID NO: 119377
  derived and/or modified sequence opt2 from hemagglutinin__InfluenzaB__AHL94827

SEQ ID NO: 119688 - RNA, 1755 nt, Artificial Sequence
  derived and/or modified sequence opt2 from hemagglutinin__InfluenzaB__AHL94837
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccgccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuacaagcucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119689 - RNA, 1755 nt, Artificial Sequence; identical to SEQ ID NO: 118366
  derived and/or modified sequence opt2 from hemagglutinin__InfluenzaB__AHL94847

SEQ ID NO: 119690 - RNA, 1758 nt, Artificial Sequence
  derived and/or modified sequence opt2 from hemagglutinin__InfluenzaB__AHL94858
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaaggccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119691 - RNA, 1755 nt, Artificial Sequence; identical to SEQ ID NO: 118332
  derived and/or modified sequence opt2 from hemagglutinin__InfluenzaB__AHL94869

SEQ ID NO: 119692 - RNA, 1758 nt, Artificial Sequence; identical to SEQ ID NO: 118501
  derived and/or modified sequence opt2 from hemagglutinin__InfluenzaB__AHL94880

SEQ ID NO: 119693 - RNA, 1758 nt, Artificial Sequence; identical to SEQ ID NO: 118834
  derived and/or modified sequence opt2 from hemagglutinin__InfluenzaB__AHL94889

SEQ ID NO: 119694 - RNA, 1758 nt, Artificial Sequence; identical to SEQ ID NO: 118501
  derived and/or modified sequence opt2 from hemagglutinin__InfluenzaB__AHL94900

SEQ ID NO: 119695 - RNA, 1758 nt, Artificial Sequence
  derived and/or modified sequence opt2 from hemagglutinin__InfluenzaB__AHL94911
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggccgcaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119696 - RNA, 1758 nt, Artificial Sequence; identical to SEQ ID NO: 118501
  derived and/or modified sequence opt2 from hemagglutinin__InfluenzaB__AHL94922

SEQ ID NO: 119697 - RNA, 1758 nt, Artificial Sequence
  derived and/or modified sequence opt2 from hemagglutinin__InfluenzaB__AHL94933
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaaggccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119698 - RNA, 1758 nt, Artificial Sequence; identical to SEQ ID NO: 119582
  derived and/or modified sequence opt2 from hemagglutinin__InfluenzaB__AHL94944

SEQ ID NO: 119699 - RNA, 1758 nt, Artificial Sequence; identical to SEQ ID NO: 118195
  derived and/or modified sequence opt2 from hemagglutinin__InfluenzaB__AHL94955

SEQ ID NO: 119700 - RNA, 1758 nt, Artificial Sequence; identical to SEQ ID NO: 118195
  derived and/or modified sequence opt2 from hemagglutinin__InfluenzaB__AHL94965

SEQ ID NO: 119701 - RNA, 1758 nt, Artificial Sequence; identical to SEQ ID NO: 118195
  derived and/or modified sequence opt2 from hemagglutinin__InfluenzaB__AHL94975

SEQ ID NO: 119702 - RNA, 1755 nt, Artificial Sequence; identical to SEQ ID NO: 118366
  derived and/or modified sequence opt2 from hemagglutinin__InfluenzaB__AHM00986

SEQ ID NO: 119703 - RNA, 1758 nt, Artificial Sequence; identical to SEQ ID NO: 118399
  derived and/or modified sequence opt2 from hemagglutinin__InfluenzaB__AHM00997

SEQ ID NO: 119704 - RNA, 1758 nt, Artificial Sequence
  derived and/or modified sequence opt2 from hemagglutinin__InfluenzaB__AHM01008
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccuggaccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119705 - RNA, 1758 nt, Artificial Sequence; identical to SEQ ID NO: 118399
  derived and/or modified sequence opt2 from hemagglutinin__InfluenzaB__AHM01019

SEQ ID NO: 119706 - RNA, 1758 nt, Artificial Sequence; identical to SEQ ID NO: 118399
  derived and/or modified sequence opt2 from hemagglutinin__InfluenzaB__AHM01030

SEQ ID NO: 119707 - RNA, 1758 nt, Artificial Sequence
  derived and/or modified sequence opt2 from hemagglutinin__InfluenzaB__AHM01041
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccgagaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119708 - RNA, 1758 nt, Artificial Sequence
  derived and/or modified sequence opt2 from hemagglutinin__InfluenzaB__AHM01052
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccaucaugcucuacuacuccaccgccgccuccucccucgccgucacccucaugaucgccaucuucgucgucuacauggucucccgcgacaacgucuccugcuccaucugccucuga

SEQ ID NO: 119709 - RNA, 1758 nt, Artificial Sequence; identical to SEQ ID NO: 118399
  derived and/or modified sequence opt2 from hemagglutinin__InfluenzaB__AHM01063

SEQ ID NO: 119710 - RNA, 1755 nt, Artificial Sequence; identical to SEQ ID NO: 118366
  derived and/or modified sequence opt2 from hemagglutinin__InfluenzaB__AHM01074

SEQ ID NO: 119711 - RNA, 1755 nt, Artificial Sequence
  derived and/or modified sequence opt2 from hemagglutinin__InfluenzaB__AHM01096
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119712 - RNA, 1758 nt, Artificial Sequence; identical to SEQ ID NO: 118399
  derived and/or modified sequence opt2 from hemagglutinin__InfluenzaB__AHM01107

SEQ ID NO: 119713 - RNA, 1758 nt, Artificial Sequence
  derived and/or modified sequence opt2 from hemagglutinin__InfluenzaB__AHM01118
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgucucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119714 - RNA, 1758 nt, Artificial Sequence; identical to SEQ ID NO: 118399
  derived and/or modified sequence opt2 from hemagglutinin__InfluenzaB__AHM01129

SEQ ID NO: 119715 - RNA, 1758 nt, Artificial Sequence
  derived and/or modified sequence opt2 from hemagglutinin__InfluenzaB__AHM01140
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccgcccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119716 - RNA, 1758 nt, Artificial Sequence; identical to SEQ ID NO: 118384
  derived and/or modified sequence opt2 from hemagglutinin__InfluenzaB__AHM01151

SEQ ID NO: 119717 - RNA, 1758 nt, Artificial Sequence
  derived and/or modified sequence opt2 from hemagglutinin__InfluenzaB__AHM01162
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccaaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119718 - RNA, 1755 nt, Artificial Sequence; identical to SEQ ID NO: 118366
  derived and/or modified sequence opt2 from hemagglutinin__InfluenzaB__AHM01173

SEQ ID NO: 119719 - RNA, 1758 nt, Artificial Sequence
  derived and/or modified sequence opt2 from hemagglutinin__InfluenzaB__AHM01184
augaaggccaucaucguccuccucauggucgucaccuccaacgccgaccgcaucugcaccggcaucaccuccuccaacuccccccacgucgucaagaccgccacccagggcgaggucaacgucaccggcgucaucacccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119720 - RNA, 1758 nt, Artificial Sequence; identical to SEQ ID NO: 119715
  derived and/or modified sequence opt2 from hemagglutinin__InfluenzaB__AHM01195

SEQ ID NO: 119721 - RNA, 1758 nt, Artificial Sequence
  derived and/or modified sequence opt2 from hemagglutinin__InfluenzaB__AHM01206
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccgagaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucggcaaccacaccauccuccucuacuacuccaccgccgccuccucccucgccgucacccucaugaucgccaucuucgucgucuacauggucucccgcgacaacgucuccugcuccaucugccucuga

SEQ ID NO: 119722 - RNA, 1758 nt, Artificial Sequence; identical to SEQ ID NO: 118384
  derived and/or modified sequence opt2 from hemagglutinin__InfluenzaB__AHM01217

SEQ ID NO: 119723 - RNA, 1755 nt, Artificial Sequence; identical to SEQ ID NO: 118366
  derived and/or modified sequence opt2 from hemagglutinin__InfluenzaB__AHM01228

SEQ ID NO: 119724 - RNA, 1758 nt, Artificial Sequence; identical to SEQ ID NO: 118399
  derived and/or modified sequence opt2 from hemagglutinin__InfluenzaB__AHM01239

SEQ ID NO: 119725 - RNA, 1758 nt, Artificial Sequence; identical to SEQ ID NO: 118399
  derived and/or modified sequence opt2 from hemagglutinin__InfluenzaB__AHM01250

SEQ ID NO: 119726 - RNA, 1758 nt, Artificial Sequence
  derived and/or modified sequence opt2 from hemagglutinin__InfluenzaB__AHM01261
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccaucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccggcggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119727 - RNA, 1755 nt, Artificial Sequence; identical to SEQ ID NO: 118366
  derived and/or modified sequence opt2 from hemagglutinin__InfluenzaB__AHM01272

SEQ ID NO: 119728 - RNA, 1758 nt, Artificial Sequence; identical to SEQ ID NO: 119715
  derived and/or modified sequence opt2 from hemagglutinin__InfluenzaB__AHM01283

SEQ ID NO: 119729 - RNA, 1758 nt, Artificial Sequence; identical to SEQ ID NO: 119715
  derived and/or modified sequence opt2 from hemagglutinin__InfluenzaB__AHM01294

SEQ ID NO: 119730 - RNA, 1755 nt, Artificial Sequence; identical to SEQ ID NO: 118366
  derived and/or modified sequence opt2 from hemagglutinin__InfluenzaB__AHM01305

SEQ ID NO: 119731 - RNA, 1758 nt, Artificial Sequence; identical to SEQ ID NO: 118399
  derived and/or modified sequence opt2 from hemagglutinin__InfluenzaB__AHM01316

SEQ ID NO: 119732 - RNA, 1758 nt, Artificial Sequence; identical to SEQ ID NO: 119715
  derived and/or modified sequence opt2 from hemagglutinin__InfluenzaB__AHM01327

SEQ ID NO: 119733 - RNA, 1758 nt, Artificial Sequence; identical to SEQ ID NO: 118399
  derived and/or modified sequence opt2 from hemagglutinin__InfluenzaB__AHM01338

SEQ ID NO: 119734 - RNA, 1758 nt, Artificial Sequence; identical to SEQ ID NO: 118399
  derived and/or modified sequence opt2 from hemagglutinin__InfluenzaB__AHM01349

SEQ ID NO: 119735 - RNA, 1758 nt, Artificial Sequence
  derived and/or modified sequence opt2 from hemagglutinin__InfluenzaB__AHM01360
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccaagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119736 - RNA, 1755 nt, Artificial Sequence
  derived and/or modified sequence opt2 from hemagglutinin__InfluenzaB__AHM01371
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaagaacggcuucuucgccaccauggccugggccguccccaaggacaacaacaagaacgccaccaacccccucaccgucgagguccccuacaucugcgccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119737 - RNA, 1755 nt, Artificial Sequence; identical to SEQ ID NO: 118366
  derived and/or modified sequence opt2 from hemagglutinin__InfluenzaB__AHM01382

SEQ ID NO: 119738 - RNA, 1758 nt, Artificial Sequence
  derived and/or modified sequence opt2 from hemagglutinin__InfluenzaB__AHM01393
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119739 - RNA, 1758 nt, Artificial Sequence; identical to SEQ ID NO: 118399
  derived and/or modified sequence opt2 from hemagglutinin__InfluenzaB__AHM01404

SEQ ID NO: 119740 - RNA, 1758 nt, Artificial Sequence
  derived and/or modified sequence opt2 from hemagglutinin__InfluenzaB__AHM01415
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucaucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119741 - RNA, 1758 nt, Artificial Sequence
  derived and/or modified sequence opt2 from hemagglutinin__InfluenzaB__AHM01426
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccaucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119742 - RNA, 1755 nt, Artificial Sequence
  derived and/or modified sequence opt2 from hemagglutinin__InfluenzaB__AHM01437
augaaggccgucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgaggaggaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119743 - RNA, 1755 nt, Artificial Sequence
  derived and/or modified sequence opt2 from hemagglutinin__InfluenzaB__AHM01448
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgccgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119744 - RNA, 1758 nt, Artificial Sequence; identical to SEQ ID NO: 118157
  derived and/or modified sequence opt2 from hemagglutinin__InfluenzaB__AHM01459

SEQ ID NO: 119745 - RNA, 1755 nt, Artificial Sequence
  derived and/or modified sequence opt2 from hemagglutinin__InfluenzaB__AHM01470
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucgccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccgucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119746 - RNA, 1755 nt, Artificial Sequence
  derived and/or modified sequence opt2 from hemagglutinin__InfluenzaB__AHM01481
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagcgcgucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119747 - RNA, 1755 nt, Artificial Sequence; identical to SEQ ID NO: 118411
  derived and/or modified sequence opt2 from hemagglutinin__InfluenzaB__AHM01492

SEQ ID NO: 119748 - RNA, 1755 nt, Artificial Sequence; identical to SEQ ID NO: 118366
  derived and/or modified sequence opt2 from hemagglutinin__InfluenzaB__AHM01503

SEQ ID NO: 119749 - RNA, 1755 nt, Artificial Sequence; identical to SEQ ID NO: 118366
  derived and/or modified sequence opt2 from hemagglutinin__InfluenzaB__AHM01514

SEQ ID NO: 119750 - RNA, 1755 nt, Artificial Sequence
  derived and/or modified sequence opt2 from hemagglutinin__InfluenzaB__AHM01525
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugauccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119751 - RNA, 1755 nt, Artificial Sequence
  derived and/or modified sequence opt2 from hemagglutinin__InfluenzaB__AHM01536
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcguccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119752 - RNA, 1755 nt, Artificial Sequence; identical to SEQ ID NO: 118366
  derived and/or modified sequence opt2 from hemagglutinin__InfluenzaB__AHM01547

SEQ ID NO: 119753 - RNA, 1755 nt, Artificial Sequence; identical to SEQ ID NO: 118411
  derived and/or modified sequence opt2 from hemagglutinin__InfluenzaB__AHM01558

SEQ ID NO: 119754 - RNA, 1758 nt, Artificial Sequence; identical to SEQ ID NO: 118252
  derived and/or modified sequence opt2 from hemagglutinin__InfluenzaB__AHV83951

SEQ ID NO: 119755 - RNA, 1755 nt, Artificial Sequence; identical to SEQ ID NO: 119641
  derived and/or modified sequence opt2 from hemagglutinin__InfluenzaB__AHV83952

SEQ ID NO: 119756 - RNA, 1758 nt, Artificial Sequence; identical to SEQ ID NO: 118195
  derived and/or modified sequence opt2 from hemagglutinin__InfluenzaB__AHZ36697

SEQ ID NO: 119757 - RNA, 1758 nt, Artificial Sequence
  derived and/or modified sequence opt2 from hemagglutinin__InfluenzaB__AHZ36708
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccucaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcaccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119758 - RNA, 1758 nt, Artificial Sequence
  derived and/or modified sequence opt2 from hemagglutinin__InfluenzaB__AHZ36719
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacgucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119759 - RNA, 1758 nt, Artificial Sequence; identical to SEQ ID NO: 118195
  derived and/or modified sequence opt2 from hemagglutinin__InfluenzaB__AHZ36730

SEQ ID NO: 119760 - RNA, 1758 nt, Artificial Sequence; identical to SEQ ID NO: 118195
  derived and/or modified sequence opt2 from hemagglutinin__InfluenzaB__AHZ36752

SEQ ID NO: 119761 - RNA, 1758 nt, Artificial Sequence; identical to SEQ ID NO: 118157
  derived and/or modified sequence opt2 from hemagglutinin__InfluenzaB__AHZ36763

SEQ ID NO: 119762 - RNA, 1758 nt, Artificial Sequence
  derived and/or modified sequence opt2 from hemagglutinin__InfluenzaB__AHZ36774
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaguccgcccccggcggccccuacaagaucggcaccuccggcuccugccccaacgucaccaacggcaacggcuucuucgccaccauggccugggccguccccaagaacgacaagaacaagaccgccaccgacccccucaccaucgagguccccuacaucugcaccgaggaggaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaaggucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119763 - RNA, 1758 nt, Artificial Sequence; identical to SEQ ID NO: 119671
  derived and/or modified sequence opt2 from hemagglutinin__InfluenzaB__AHZ36785

SEQ ID NO: 119764 - RNA, 1758 nt, Artificial Sequence; identical to SEQ ID NO: 119671
  derived and/or modified sequence opt2 from hemagglutinin__InfluenzaB__AHZ36796

SEQ ID NO: 119765 - RNA, 1755 nt, Artificial Sequence
  derived and/or modified sequence opt2 from hemagglutinin__InfluenzaB__AHZ36807
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccgagaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119766 - RNA, 1758 nt, Artificial Sequence; identical to SEQ ID NO: 118195
  derived and/or modified sequence opt2 from hemagglutinin__InfluenzaB__AHZ36818

SEQ ID NO: 119767 - RNA, 1758 nt, Artificial Sequence; identical to SEQ ID NO: 118157
  derived and/or modified sequence opt2 from hemagglutinin__InfluenzaB__AHZ36829

SEQ ID NO: 119768 - RNA, 1758 nt, Artificial Sequence; identical to SEQ ID NO: 118157
  derived and/or modified sequence opt2 from hemagglutinin__InfluenzaB__AHZ36840

SEQ ID NO: 119769 - RNA, 1758 nt, Artificial Sequence; identical to SEQ ID NO: 119671
  derived and/or modified sequence opt2 from hemagglutinin__InfluenzaB__AHZ36851

SEQ ID NO: 119770 - RNA, 1758 nt, Artificial Sequence; identical to SEQ ID NO: 118195
  derived and/or modified sequence opt2 from hemagglutinin__InfluenzaB__AHZ36862

SEQ ID NO: 119771 - RNA, 1758 nt, Artificial Sequence; identical to SEQ ID NO: 118157
  derived and/or modified sequence opt2 from hemagglutinin__InfluenzaB__AHZ36873

SEQ ID NO: 119772 - RNA, 1758 nt, Artificial Sequence
  derived and/or modified sequence opt2 from hemagglutinin__InfluenzaB__AHZ36884
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgagaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119773 - RNA, 1758 nt, Artificial Sequence; identical to SEQ ID NO: 118195
  derived and/or modified sequence opt2 from hemagglutinin__InfluenzaB__AHZ36895

SEQ ID NO: 119774 - RNA, 1758 nt, Artificial Sequence; identical to SEQ ID NO: 118195
  derived and/or modified sequence opt2 from hemagglutinin__InfluenzaB__AHZ36906

SEQ ID NO: 119775 - RNA, 1758 nt, Artificial Sequence
  derived and/or modified sequence opt2 from hemagglutinin__InfluenzaB__AHZ36928
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccucaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119776 - RNA, 1758 nt, Artificial Sequence; identical to SEQ ID NO: 119671
  derived and/or modified sequence opt2 from hemagglutinin__InfluenzaB__AHZ36939

SEQ ID NO: 119777 - RNA, 1758 nt, Artificial Sequence
  derived and/or modified sequence opt2 from hemagglutinin__InfluenzaB__AHZ36950
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccaucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119778 - RNA, 1758 nt, Artificial Sequence
  derived and/or modified sequence opt2 from hemagglutinin__InfluenzaB__AHZ36961
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggcggcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119779 - RNA, 1758 nt, Artificial Sequence; identical to SEQ ID NO: 118195
  derived and/or modified sequence opt2 from hemagglutinin__InfluenzaB__AHZ36972

SEQ ID NO: 119780 - RNA, 1758 nt, Artificial Sequence
  derived and/or modified sequence opt2 from hemagglutinin__InfluenzaB__AHZ36983
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccgcccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119781 - RNA, 1758 nt, Artificial Sequence
  derived and/or modified sequence opt2 from hemagglutinin__InfluenzaB__AHZ37005
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaguccgcccccggcggccccuacaagaucggcaccuccggcuccugccccaacgucaccaacggcaacggcuucuucgccaccauggccugggccguccccaagaacgacaagaacaagaccgccaccgacccccucaccaucgagguccccuacaucugcaccgaggaggaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119782 - RNA, 1758 nt, Artificial Sequence; identical to SEQ ID NO: 118157
  derived and/or modified sequence opt2 from hemagglutinin__InfluenzaB__AHZ37016

SEQ ID NO: 119783 - RNA, 1758 nt, Artificial Sequence
  derived and/or modified sequence opt2 from hemagglutinin__InfluenzaB__AHZ37027
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccaucauccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccucaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119784 - RNA, 1758 nt, Artificial Sequence; identical to SEQ ID NO: 118157
  derived and/or modified sequence opt2 from hemagglutinin__InfluenzaB__AHZ37038

SEQ ID NO: 119785 - RNA, 1758 nt, Artificial Sequence; identical to SEQ ID NO: 119671
  derived and/or modified sequence opt2 from hemagglutinin__InfluenzaB__AHZ37049

SEQ ID NO: 119786 - RNA, 1758 nt, Artificial Sequence; identical to SEQ ID NO: 119671
  derived and/or modified sequence opt2 from hemagglutinin__InfluenzaB__AHZ37060

SEQ ID NO: 119787 - RNA, 1758 nt, Artificial Sequence; identical to SEQ ID NO: 118157
  derived and/or modified sequence opt2 from hemagglutinin__InfluenzaB__AHZ37071

SEQ ID NO: 119788 - RNA, 1758 nt, Artificial Sequence; identical to SEQ ID NO: 118157
  derived and/or modified sequence opt2 from hemagglutinin__InfluenzaB__AHZ37082

SEQ ID NO: 119789 - RNA, 1758 nt, Artificial Sequence; identical to SEQ ID NO: 119671
  derived and/or modified sequence opt2 from hemagglutinin__InfluenzaB__AHZ37093

SEQ ID NO: 119790 - RNA, 1758 nt, Artificial Sequence
  derived and/or modified sequence opt2 from hemagglutinin__InfluenzaB__AHZ37104
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgaccacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119791 - RNA, 1758 nt, Artificial Sequence
  derived and/or modified sequence opt2 from hemagglutinin__InfluenzaB__AHZ41770
augaaggccaucaucguccuccucauggucgucaccuccaacgccgaccgcaucugcaccggcaucaccuccuccaacuccccccacaucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaucaacccccucaccaucgagguccccuacaucugcaccgagggcgaggaccagaucaccgucuggggcuuccacuccgacaacgagacccagauggccaagcucuacggcgacuccgagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119792 - RNA, 1758 nt, Artificial Sequence; identical to SEQ ID NO: 118195
  derived and/or modified sequence opt2 from hemagglutinin__InfluenzaB__AHZ41781

SEQ ID NO: 119793 - RNA, 1758 nt, Artificial Sequence; identical to SEQ ID NO: 118195
  derived and/or modified sequence opt2 from hemagglutinin__InfluenzaB__AHZ41792

SEQ ID NO: 119794 - RNA, 1758 nt, Artificial Sequence; identical to SEQ ID NO: 118195
  derived and/or modified sequence opt2 from hemagglutinin__InfluenzaB__AHZ41803

SEQ ID NO: 119795 - RNA, 1758 nt, Artificial Sequence
  derived and/or modified sequence opt2 from hemagglutinin__InfluenzaB__AHZ41814
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccgucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119796 - RNA, 1758 nt, Artificial Sequence; identical to SEQ ID NO: 118195
  derived and/or modified sequence opt2 from hemagglutinin__InfluenzaB__AHZ41825

SEQ ID NO: 119797 - RNA, 1758 nt, Artificial Sequence; identical to SEQ ID NO: 118195
  derived and/or modified sequence opt2 from hemagglutinin__InfluenzaB__AHZ41836

SEQ ID NO: 119798 - RNA, 1758 nt, Artificial Sequence; identical to SEQ ID NO: 118195
  derived and/or modified sequence opt2 from hemagglutinin__InfluenzaB__AHZ41847

SEQ ID NO: 119799 - RNA, 1755 nt, Artificial Sequence; identical to SEQ ID NO: 119643
  derived and/or modified sequence opt2 from hemagglutinin__InfluenzaB__AHZ41858

SEQ ID NO: 119800 - RNA, 1758 nt, Artificial Sequence; identical to SEQ ID NO: 119668
  derived and/or modified sequence opt2 from hemagglutinin__InfluenzaB__AHZ41869

SEQ ID NO: 119801 - RNA, 1755 nt, Artificial Sequence
  derived and/or modified sequence opt2 from hemagglutinin__InfluenzaB__AIC73844
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119802 - RNA, 1758 nt, Artificial Sequence; identical to SEQ ID NO: 119377
  derived and/or modified sequence opt2 from hemagglutinin__InfluenzaB__AIC73845

SEQ ID NO: 119803 - RNA, 1758 nt, Artificial Sequence; identical to SEQ ID NO: 119377
  derived and/or modified sequence opt2 from hemagglutinin__InfluenzaB__AIC73846

SEQ ID NO: 119804 - RNA, 1758 nt, Artificial Sequence
  derived and/or modified sequence opt2 from hemagglutinin__InfluenzaB__AIC73847
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucgacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119805 - RNA, 1758 nt, Artificial Sequence; identical to SEQ ID NO: 119377
  derived and/or modified sequence opt2 from hemagglutinin__InfluenzaB__AIC73848

SEQ ID NO: 119806 - RNA, 1755 nt, Artificial Sequence; identical to SEQ ID NO: 119641
  derived and/or modified sequence opt2 from hemagglutinin__InfluenzaB__AIC73849

SEQ ID NO: 119807 - RNA, 1758 nt, Artificial Sequence
  derived and/or modified sequence opt2 from hemagglutinin__InfluenzaB__AIC73850
augaaggccaucaucguccuccucauggucgccaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119808 - RNA, 1758 nt, Artificial Sequence; identical to SEQ ID NO: 118399
  derived and/or modified sequence opt2 from hemagglutinin__InfluenzaB__AIC73851

SEQ ID NO: 119809 - RNA, 1755 nt, Artificial Sequence; identical to SEQ ID NO: 119801
  derived and/or modified sequence opt2 from hemagglutinin__InfluenzaB__AIC73852

SEQ ID NO: 119810 - RNA, 1755 nt, Artificial Sequence; identical to SEQ ID NO: 119801
  derived and/or modified sequence opt2 from hemagglutinin__InfluenzaB__AIC73853

SEQ ID NO: 119811 - RNA, 1758 nt, Artificial Sequence
  derived and/or modified sequence opt2 from hemagglutinin__InfluenzaB__AIC73855
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaucaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119812 - RNA, 1758 nt, Artificial Sequence; identical to SEQ ID NO: 119377
  derived and/or modified sequence opt2 from hemagglutinin__InfluenzaB__AIC73856

SEQ ID NO: 119813 - RNA, 1758 nt, Artificial Sequence; identical to SEQ ID NO: 119377
  derived and/or modified sequence opt2 from hemagglutinin__InfluenzaB__AIC73857

SEQ ID NO: 119814 - RNA, 1758 nt, Artificial Sequence; identical to SEQ ID NO: 119377
  derived and/or modified sequence opt2 from hemagglutinin__InfluenzaB__AIC73859

SEQ ID NO: 119815 - RNA, 1758 nt, Artificial Sequence
  derived and/or modified sequence opt2 from hemagglutinin__InfluenzaB__AIC73860
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccauguccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119816 - RNA, 1758 nt, Artificial Sequence
  derived and/or modified sequence opt2 from hemagglutinin__InfluenzaB__AIC73861
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacaccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccauccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119817 - RNA, 1758 nt, Artificial Sequence; identical to SEQ ID NO: 119815
  derived and/or modified sequence opt2 from hemagglutinin__InfluenzaB__AIC73862

SEQ ID NO: 119818 - RNA, 1758 nt, Artificial Sequence; identical to SEQ ID NO: 119815
  derived and/or modified sequence opt2 from hemagglutinin__InfluenzaB__AIC73863

SEQ ID NO: 119819 - RNA, 1758 nt, Artificial Sequence; identical to SEQ ID NO: 119815
  derived and/or modified sequence opt2 from hemagglutinin__InfluenzaB__AIC73864

SEQ ID NO: 119820 - RNA, 1755 nt, Artificial Sequence
  derived and/or modified sequence opt2 from hemagglutinin__InfluenzaB__AIC73865
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagcgcgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119821 - RNA, 1758 nt, Artificial Sequence
  derived and/or modified sequence opt2 from hemagglutinin__InfluenzaB__AIC73867
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucgacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119822 - RNA, 1758 nt, Artificial Sequence; identical to SEQ ID NO: 118399
  derived and/or modified sequence opt2 from hemagglutinin__InfluenzaB__AIC73868

SEQ ID NO: 119823 - RNA, 1758 nt, Artificial Sequence; identical to SEQ ID NO: 119815
  derived and/or modified sequence opt2 from hemagglutinin__InfluenzaB__AIC73869

SEQ ID NO: 119824 - RNA, 1758 nt, Artificial Sequence; identical to SEQ ID NO: 119815
  derived and/or modified sequence opt2 from hemagglutinin__InfluenzaB__AIC73870

SEQ ID NO: 119825 - RNA, 1758 nt, Artificial Sequence; identical to SEQ ID NO: 119377
  derived and/or modified sequence opt2 from hemagglutinin__InfluenzaB__AIC73871

SEQ ID NO: 119826 - RNA, 1755 nt, Artificial Sequence; identical to SEQ ID NO: 119801
  derived and/or modified sequence opt2 from hemagglutinin__InfluenzaB__AIC73872

SEQ ID NO: 119827 - RNA, 1755 nt, Artificial Sequence; identical to SEQ ID NO: 119641
  derived and/or modified sequence opt2 from hemagglutinin__InfluenzaB__AIC73873

SEQ ID NO: 119828 - RNA, 1755 nt, Artificial Sequence; identical to SEQ ID NO: 119801
  derived and/or modified sequence opt2 from hemagglutinin__InfluenzaB__AIC73874

SEQ ID NO: 119829 - RNA, 1755 nt, Artificial Sequence; identical to SEQ ID NO: 119820
  derived and/or modified sequence opt2 from hemagglutinin__InfluenzaB__AIC73875

SEQ ID NO: 119830 - RNA, 1755 nt, Artificial Sequence
  derived and/or modified sequence opt2 from hemagglutinin__InfluenzaB__AIC73876
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccgaccagcgcgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucaaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119831 - RNA, 1755 nt, Artificial Sequence; identical to SEQ ID NO: 119820
  derived and/or modified sequence opt2 from hemagglutinin__InfluenzaB__AIC73877

SEQ ID NO: 119832 - RNA, 1755 nt, Artificial Sequence; identical to SEQ ID NO: 119820
  derived and/or modified sequence opt2 from hemagglutinin__InfluenzaB__AIC73878

SEQ ID NO: 119833 - RNA, 1755 nt, Artificial Sequence; identical to SEQ ID NO: 119820
  derived and/or modified sequence opt2 from hemagglutinin__InfluenzaB__AIC73879

SEQ ID NO: 119834 - RNA, 1755 nt, Artificial Sequence; identical to SEQ ID NO: 119820
  derived and/or modified sequence opt2 from hemagglutinin__InfluenzaB__AIC73880

SEQ ID NO: 119835 - RNA, 1755 nt, Artificial Sequence; identical to SEQ ID NO: 119820
  derived and/or modified sequence opt2 from hemagglutinin__InfluenzaB__AIC73881

SEQ ID NO: 119836 - RNA, 1755 nt, Artificial Sequence; identical to SEQ ID NO: 119820
  derived and/or modified sequence opt2 from hemagglutinin__InfluenzaB__AIC73882

SEQ ID NO: 119837 - RNA, 1755 nt, Artificial Sequence; identical to SEQ ID NO: 119641
  derived and/or modified sequence opt2 from hemagglutinin__InfluenzaB__AIC73883

SEQ ID NO: 119838 - RNA, 1755 nt, Artificial Sequence; identical to SEQ ID NO: 119820
  derived and/or modified sequence opt2 from hemagglutinin__InfluenzaB__AIC73884

SEQ ID NO: 119839 - RNA, 1758 nt, Artificial Sequence
  derived and/or modified sequence opt2 from hemagglutinin__InfluenzaB__AIC73885
auggaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119840 - RNA, 1758 nt, Artificial Sequence; identical to SEQ ID NO: 119377
  derived and/or modified sequence opt2 from hemagglutinin__InfluenzaB__AIC73886

SEQ ID NO: 119841 - RNA, 1758 nt, Artificial Sequence; identical to SEQ ID NO: 119821
  derived and/or modified sequence opt2 from hemagglutinin__InfluenzaB__AIC73887

SEQ ID NO: 119842 - RNA, 1755 nt, Artificial Sequence; identical to SEQ ID NO: 119641
  derived and/or modified sequence opt2 from hemagglutinin__InfluenzaB__AIC73888

SEQ ID NO: 119843 - RNA, 1755 nt, Artificial Sequence; identical to SEQ ID NO: 119801
  derived and/or modified sequence opt2 from hemagglutinin__InfluenzaB__AIC73889

SEQ ID NO: 119844 - RNA, 1755 nt, Artificial Sequence; identical to SEQ ID NO: 119801
  derived and/or modified sequence opt2 from hemagglutinin__InfluenzaB__AIC73890

SEQ ID NO: 119845 - RNA, 1758 nt, Artificial Sequence
  derived and/or modified sequence opt2 from hemagglutinin__InfluenzaB__AIC73892
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccucccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119846 - RNA, 1755 nt, Artificial Sequence; identical to SEQ ID NO: 119641
  derived and/or modified sequence opt2 from hemagglutinin__InfluenzaB__AIC73893

SEQ ID NO: 119847 - RNA, 1755 nt, Artificial Sequence; identical to SEQ ID NO: 119801
  derived and/or modified sequence opt2 from hemagglutinin__InfluenzaB__AIC73894

SEQ ID NO: 119848 - RNA, 1755 nt, Artificial Sequence; identical to SEQ ID NO: 119801
  derived and/or modified sequence opt2 from hemagglutinin__InfluenzaB__AIC73895

SEQ ID NO: 119849 - RNA, 1755 nt, Artificial Sequence; identical to SEQ ID NO: 119801
  derived and/or modified sequence opt2 from hemagglutinin__InfluenzaB__AIC73896

SEQ ID NO: 119850 - RNA, 1755 nt, Artificial Sequence; identical to SEQ ID NO: 119801
  derived and/or modified sequence opt2 from hemagglutinin__InfluenzaB__AIC73897

SEQ ID NO: 119851 - RNA, 1755 nt, Artificial Sequence; identical to SEQ ID NO: 119801
  derived and/or modified sequence opt2 from hemagglutinin__InfluenzaB__AIC73898

SEQ ID NO: 119852 - RNA, 1755 nt, Artificial Sequence; identical to SEQ ID NO: 119801
  derived and/or modified sequence opt2 from hemagglutinin__InfluenzaB__AIC73899

SEQ ID NO: 119853 - RNA, 1755 nt, Artificial Sequence; identical to SEQ ID NO: 119801
  derived and/or modified sequence opt2 from hemagglutinin__InfluenzaB__AIC73900

SEQ ID NO: 119854 - RNA, 1755 nt, Artificial Sequence; identical to SEQ ID NO: 119801
  derived and/or modified sequence opt2 from hemagglutinin__InfluenzaB__AIC73902

SEQ ID NO: 119855 - RNA, 1755 nt, Artificial Sequence
  derived and/or modified sequence opt2 from hemagglutinin__InfluenzaB__AIC73903
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcaucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119856 - RNA, 1755 nt, Artificial Sequence
  derived and/or modified sequence opt2 from hemagglutinin__InfluenzaB__AIC73904
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaucacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119857 - RNA, 1755 nt, Artificial Sequence; identical to SEQ ID NO: 119801
  derived and/or modified sequence opt2 from hemagglutinin__InfluenzaB__AIC73905

SEQ ID NO: 119858 - RNA, 1755 nt, Artificial Sequence; identical to SEQ ID NO: 119801
  derived and/or modified sequence opt2 from hemagglutinin__InfluenzaB__AIC73906

SEQ ID NO: 119859 - RNA, 1755 nt, Artificial Sequence; identical to SEQ ID NO: 119801
  derived and/or modified sequence opt2 from hemagglutinin__InfluenzaB__AIC73907

SEQ ID NO: 119860 - RNA, 1755 nt, Artificial Sequence; identical to SEQ ID NO: 119801
  derived and/or modified sequence opt2 from hemagglutinin__InfluenzaB__AIC73908

SEQ ID NO: 119861 - RNA, 1755 nt, Artificial Sequence; identical to SEQ ID NO: 119801
  derived and/or modified sequence opt2 from hemagglutinin__InfluenzaB__AIC73909

SEQ ID NO: 119862 - RNA, 1755 nt, Artificial Sequence; identical to SEQ ID NO: 119801
  derived and/or modified sequence opt2 from hemagglutinin__InfluenzaB__AIC73910

SEQ ID NO: 119863 - RNA, 1755 nt, Artificial Sequence; identical to SEQ ID NO: 119801
  derived and/or modified sequence opt2 from hemagglutinin__InfluenzaB__AIC73911

SEQ ID NO: 119864 - RNA, 1755 nt, Artificial Sequence; identical to SEQ ID NO: 119801
  derived and/or modified sequence opt2 from hemagglutinin__InfluenzaB__AIC73912

SEQ ID NO: 119865 - RNA, 1755 nt, Artificial Sequence; identical to SEQ ID NO: 119801
  derived and/or modified sequence opt2 from hemagglutinin__InfluenzaB__AIC73913

SEQ ID NO: 119866 - RNA, 1755 nt, Artificial Sequence; identical to SEQ ID NO: 119801
  derived and/or modified sequence opt2 from hemagglutinin__InfluenzaB__AIC73914

SEQ ID NO: 119867 - RNA, 1755 nt, Artificial Sequence; identical to SEQ ID NO: 119801
  derived and/or modified sequence opt2 from hemagglutinin__InfluenzaB__AIC73915

SEQ ID NO: 119868 - RNA, 1755 nt, Artificial Sequence; identical to SEQ ID NO: 119801
  derived and/or modified sequence opt2 from hemagglutinin__InfluenzaB__AIC73916

SEQ ID NO: 119869 - RNA, 1755 nt, Artificial Sequence; identical to SEQ ID NO: 119801
  derived and/or modified sequence opt2 from hemagglutinin__InfluenzaB__AIC73917

SEQ ID NO: 119870 - RNA, 1755 nt, Artificial Sequence; identical to SEQ ID NO: 119801
  derived and/or modified sequence opt2 from hemagglutinin__InfluenzaB__AIC73918

SEQ ID NO: 119871 - RNA, 1755 nt, Artificial Sequence; identical to SEQ ID NO: 119641
  derived and/or modified sequence opt2 from hemagglutinin__InfluenzaB__AIC73919

SEQ ID NO: 119872 - RNA, 1755 nt, Artificial Sequence; identical to SEQ ID NO: 119801
  derived and/or modified sequence opt2 from hemagglutinin__InfluenzaB__AIC73920

SEQ ID NO: 119873 - RNA, 1758 nt, Artificial Sequence; identical to SEQ ID NO: 119377
  derived and/or modified sequence opt2 from hemagglutinin__InfluenzaB__AIC73921

SEQ ID NO: 119874 - RNA, 1755 nt, Artificial Sequence; identical to SEQ ID NO: 119801
  derived and/or modified sequence opt2 from hemagglutinin__InfluenzaB__AIC73922

SEQ ID NO: 119875 - RNA, 1758 nt, Artificial Sequence; identical to SEQ ID NO: 118399
  derived and/or modified sequence opt2 from hemagglutinin__InfluenzaB__AIC73924

SEQ ID NO: 119876 - RNA, 1758 nt, Artificial Sequence
  derived and/or modified sequence opt2 from hemagglutinin__InfluenzaB__AIC73925
augaaggccaccaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119877 - RNA, 1755 nt, Artificial Sequence; identical to SEQ ID NO: 119801
  derived and/or modified sequence opt2 from hemagglutinin__InfluenzaB__AIC73926

SEQ ID NO: 119878 - RNA, 1755 nt, Artificial Sequence; identical to SEQ ID NO: 118079
  derived and/or modified sequence opt2 from hemagglutinin__InfluenzaB__AIL94977

SEQ ID NO: 119879 - RNA, 1755 nt, Artificial Sequence; identical to SEQ ID NO: 118079
  derived and/or modified sequence opt2 from hemagglutinin__InfluenzaB__AIL94988

SEQ ID NO: 119880 - RNA, 1755 nt, Artificial Sequence
  derived and/or modified sequence opt2 from hemagglutinin__InfluenzaB__AIL94999
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaccggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119881 - RNA, 1755 nt, Artificial Sequence; identical to SEQ ID NO: 118079
  derived and/or modified sequence opt2 from hemagglutinin__InfluenzaB__AIL95010

SEQ ID NO: 119882 - RNA, 1755 nt, Artificial Sequence; identical to SEQ ID NO: 118332
  derived and/or modified sequence opt2 from hemagglutinin__InfluenzaB__AIL95021

SEQ ID NO: 119883 - RNA, 1758 nt, Artificial Sequence; identical to SEQ ID NO: 118160
  derived and/or modified sequence opt2 from hemagglutinin__InfluenzaB__AIL95032

SEQ ID NO: 119884 - RNA, 1755 nt, Artificial Sequence; identical to SEQ ID NO: 118332
  derived and/or modified sequence opt2 from hemagglutinin__InfluenzaB__AIL95043

SEQ ID NO: 119885 - RNA, 1758 nt, Artificial Sequence; identical to SEQ ID NO: 118206
  derived and/or modified sequence opt2 from hemagglutinin__InfluenzaB__AIL95054

SEQ ID NO: 119886 - RNA, 1758 nt, Artificial Sequence; identical to SEQ ID NO: 118160
  derived and/or modified sequence opt2 from hemagglutinin__InfluenzaB__AIL95065

SEQ ID NO: 119887 - RNA, 1758 nt, Artificial Sequence; identical to SEQ ID NO: 118157
  derived and/or modified sequence opt2 from hemagglutinin__InfluenzaB__AIL95076

SEQ ID NO: 119888 - RNA, 1758 nt, Artificial Sequence; identical to SEQ ID NO: 118160
  derived and/or modified sequence opt2 from hemagglutinin__InfluenzaB__AIL95087

SEQ ID NO: 119889 - RNA, 1755 nt, Artificial Sequence; identical to SEQ ID NO: 118332
  derived and/or modified sequence opt2 from hemagglutinin__InfluenzaB__AIL95098

SEQ ID NO: 119890 - RNA, 1758 nt, Artificial Sequence; identical to SEQ ID NO: 119671
  derived and/or modified sequence opt2 from hemagglutinin__InfluenzaB__AIL95109

SEQ ID NO: 119891 - RNA, 1758 nt, Artificial Sequence
  derived and/or modified sequence opt2 from hemagglutinin__InfluenzaB__AIL95120
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgacaagaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119892 - RNA, 1755 nt, Artificial Sequence; identical to SEQ ID NO: 119801
  derived and/or modified sequence opt2 from hemagglutinin__InfluenzaB__AKA54644

SEQ ID NO: 119893 - RNA, 1755 nt, Artificial Sequence
  derived and/or modified sequence opt2 from hemagglutinin__InfluenzaB__AKA54645
augaaggccaucaccguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagucccucuacggcgacuccaacccccagaaguucaccuccuccgccgacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119894 - RNA, 1755 nt, Artificial Sequence; identical to SEQ ID NO: 119801
  derived and/or modified sequence opt2 from hemagglutinin__InfluenzaB__AKA54646

SEQ ID NO: 119895 - RNA, 1755 nt, Artificial Sequence; identical to SEQ ID NO: 119801
  derived and/or modified sequence opt2 from hemagglutinin__InfluenzaB__AKA54647

SEQ ID NO: 119896 - RNA, 1758 nt, Artificial Sequence; identical to SEQ ID NO: 118399
  derived and/or modified sequence opt2 from hemagglutinin__InfluenzaB__AKA54648

SEQ ID NO: 119897 - RNA, 1755 nt, Artificial Sequence
  derived and/or modified sequence opt2 from hemagglutinin__InfluenzaB__AKA54649
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacaccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119898 - RNA, 1755 nt, Artificial Sequence; identical to SEQ ID NO: 119801
  derived and/or modified sequence opt2 from hemagglutinin__InfluenzaB__AKU40581

SEQ ID NO: 119899 - RNA, 1755 nt, Artificial Sequence; identical to SEQ ID NO: 119801
  derived and/or modified sequence opt2 from hemagglutinin__InfluenzaB__AKU40592

SEQ ID NO: 119900 - RNA, 1755 nt, Artificial Sequence; identical to SEQ ID NO: 119641
  derived and/or modified sequence opt2 from hemagglutinin__InfluenzaB__AKU40603

SEQ ID NO: 119901 - RNA, 1755 nt, Artificial Sequence; identical to SEQ ID NO: 119801
  derived and/or modified sequence opt2 from hemagglutinin__InfluenzaB__AKU40614

SEQ ID NO: 119902 - RNA, 1755 nt, Artificial Sequence; identical to SEQ ID NO: 119641
  derived and/or modified sequence opt2 from hemagglutinin__InfluenzaB__AKU40625

SEQ ID NO: 119903 - RNA, 1755 nt, Artificial Sequence
  derived and/or modified sequence opt2 from hemagglutinin__InfluenzaB__AKU40636
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccgccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccaccaagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaaggagggcgaggaccagaucaccgucuggggcuuccacuccgacaacaagacccagaugaagaaccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119904 - RNA, 1755 nt, Artificial Sequence
  derived and/or modified sequence opt2 from hemagglutinin__InfluenzaB__AKU40647
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagauccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119905 - RNA, 1755 nt, Artificial Sequence; identical to SEQ ID NO: 119801
  derived and/or modified sequence opt2 from hemagglutinin__InfluenzaB__AKU40658

SEQ ID NO: 119906 - RNA, 1755 nt, Artificial Sequence; identical to SEQ ID NO: 119801
  derived and/or modified sequence opt2 from hemagglutinin__InfluenzaB__AKU40669

SEQ ID NO: 119907 - RNA, 1755 nt, Artificial Sequence; identical to SEQ ID NO: 119801
  derived and/or modified sequence opt2 from hemagglutinin__InfluenzaB__AKU40680

SEQ ID NO: 119908 - RNA, 1755 nt, Artificial Sequence
  derived and/or modified sequence opt2 from hemagglutinin__InfluenzaB__AKU40691
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgaguuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119909 - RNA, 1755 nt, Artificial Sequence; identical to SEQ ID NO: 119801
  derived and/or modified sequence opt2 from hemagglutinin__InfluenzaB__AKU40702

SEQ ID NO: 119910 - RNA, 1755 nt, Artificial Sequence; identical to SEQ ID NO: 119801
  derived and/or modified sequence opt2 from hemagglutinin__InfluenzaB__AKU40713

SEQ ID NO: 119911 - RNA, 1755 nt, Artificial Sequence; identical to SEQ ID NO: 119641
  derived and/or modified sequence opt2 from hemagglutinin__InfluenzaB__AKU40724

SEQ ID NO: 119912 - RNA, 1755 nt, Artificial Sequence; identical to SEQ ID NO: 119904
  derived and/or modified sequence opt2 from hemagglutinin__InfluenzaB__AKU40735

SEQ ID NO: 119913 - RNA, 1755 nt, Artificial Sequence; identical to SEQ ID NO: 119801
  derived and/or modified sequence opt2 from hemagglutinin__InfluenzaB__AKU40746

SEQ ID NO: 119914 - RNA, 1755 nt, Artificial Sequence; identical to SEQ ID NO: 119801
  derived and/or modified sequence opt2 from hemagglutinin__InfluenzaB__AKU40757

SEQ ID NO: 119915 - RNA, 1755 nt, Artificial Sequence; identical to SEQ ID NO: 119801
  derived and/or modified sequence opt2 from hemagglutinin__InfluenzaB__AKU40768

SEQ ID NO: 119916 - RNA, 1755 nt, Artificial Sequence; identical to SEQ ID NO: 119801
  derived and/or modified sequence opt2 from hemagglutinin__InfluenzaB__AKU40779

SEQ ID NO: 119917 - RNA, 1755 nt, Artificial Sequence; identical to SEQ ID NO: 119641
  derived and/or modified sequence opt2 from hemagglutinin__InfluenzaB__AKU40790

SEQ ID NO: 119918 - RNA, 1755 nt, Artificial Sequence; identical to SEQ ID NO: 119801
  derived and/or modified sequence opt2 from hemagglutinin__InfluenzaB__AKU40801

SEQ ID NO: 119919 - RNA, 1755 nt, Artificial Sequence
  derived and/or modified sequence opt2 from hemagglutinin__InfluenzaB__AKU40812
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacucccacaccauccuccucuacuacuccaccgccgccuccucccucgccgucacccucaugcucgccaucuucaucgucuacauggucucccgcgacaacgucuccugcuccaucugccucuga

SEQ ID NO: 119920 - RNA, 1755 nt, Artificial Sequence; identical to SEQ ID NO: 119801
  derived and/or modified sequence opt2 from hemagglutinin__InfluenzaB__AKU40823

SEQ ID NO: 119921 - RNA, 1755 nt, Artificial Sequence; identical to SEQ ID NO: 119801
  derived and/or modified sequence opt2 from hemagglutinin__InfluenzaB__AKU40834

SEQ ID NO: 119922 - RNA, 1755 nt, Artificial Sequence; identical to SEQ ID NO: 119801
  derived and/or modified sequence opt2 from hemagglutinin__InfluenzaB__AKU40845

SEQ ID NO: 119923 - RNA, 1755 nt, Artificial Sequence; identical to SEQ ID NO: 119801
  derived and/or modified sequence opt2 from hemagglutinin__InfluenzaB__AKU40856

SEQ ID NO: 119924 - RNA, 1755 nt, Artificial Sequence; identical to SEQ ID NO: 119801
  derived and/or modified sequence opt2 from hemagglutinin__InfluenzaB__AKU40867

SEQ ID NO: 119925 - RNA, 1755 nt, Artificial Sequence; identical to SEQ ID NO: 119801
  derived and/or modified sequence opt2 from hemagglutinin__InfluenzaB__AKU40878

SEQ ID NO: 119926 - RNA, 1758 nt, Artificial Sequence
  derived and/or modified sequence opt2 from hemagglutinin__InfluenzaB__AKU40889
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaccgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119927 - RNA, 1755 nt, Artificial Sequence; identical to SEQ ID NO: 119801
  derived and/or modified sequence opt2 from hemagglutinin__InfluenzaB__AKU40900

SEQ ID NO: 119928 - RNA, 1755 nt, Artificial Sequence; identical to SEQ ID NO: 119641
  derived and/or modified sequence opt2 from hemagglutinin__InfluenzaB__AKU40911

SEQ ID NO: 119929 - RNA, 1755 nt, Artificial Sequence
  derived and/or modified sequence opt2 from hemagglutinin__InfluenzaB__AKU40922
augaaggccaucaucguccuccucauggucgucaccuccaacgccgaccgcaucugcaccggcaucaccuccuccaacuccccccacgucgucaagaccgucacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119930 - RNA, 1755 nt, Artificial Sequence; identical to SEQ ID NO: 119904
  derived and/or modified sequence opt2 from hemagglutinin__InfluenzaB__AKU40933

SEQ ID NO: 119931 - RNA, 1755 nt, Artificial Sequence; identical to SEQ ID NO: 119801
  derived and/or modified sequence opt2 from hemagglutinin__InfluenzaB__AKU40944

SEQ ID NO: 119932 - RNA, 1755 nt, Artificial Sequence; identical to SEQ ID NO: 119801
  derived and/or modified sequence opt2 from hemagglutinin__InfluenzaB__AKU40955

SEQ ID NO: 119933 - RNA, 1755 nt, Artificial Sequence; identical to SEQ ID NO: 119801
  derived and/or modified sequence opt2 from hemagglutinin__InfluenzaB__AKU40966

SEQ ID NO: 119934 - RNA, 1755 nt, Artificial Sequence; identical to SEQ ID NO: 119801
  derived and/or modified sequence opt2 from hemagglutinin__InfluenzaB__AKU40977

SEQ ID NO: 119935 - RNA, 1755 nt, Artificial Sequence; identical to SEQ ID NO: 119801
  derived and/or modified sequence opt2 from hemagglutinin__InfluenzaB__AKU40987

SEQ ID NO: 119936 - RNA, 1755 nt, Artificial Sequence; identical to SEQ ID NO: 119801
  derived and/or modified sequence opt2 from hemagglutinin__InfluenzaB__AKU40998

SEQ ID NO: 119937 - RNA, 1755 nt, Artificial Sequence; identical to SEQ ID NO: 119801
  derived and/or modified sequence opt2 from hemagglutinin__InfluenzaB__AKU41009

SEQ ID NO: 119938 - RNA, 1755 nt, Artificial Sequence; identical to SEQ ID NO: 119801
  derived and/or modified sequence opt2 from hemagglutinin__InfluenzaB__AKU41020

SEQ ID NO: 119939 - RNA, 1755 nt, Artificial Sequence; identical to SEQ ID NO: 119801
  derived and/or modified sequence opt2 from hemagglutinin__InfluenzaB__ALA08485

SEQ ID NO: 119940 - RNA, 1755 nt, Artificial Sequence; identical to SEQ ID NO: 119801
  derived and/or modified sequence opt2 from hemagglutinin__InfluenzaB__ALA08486

SEQ ID NO: 119941 - RNA, 1755 nt, Artificial Sequence; identical to SEQ ID NO: 119801
  derived and/or modified sequence opt2 from hemagglutinin__InfluenzaB__ALA08487

SEQ ID NO: 119942 - RNA, 1755 nt, Artificial Sequence; identical to SEQ ID NO: 119801
  derived and/or modified sequence opt2 from hemagglutinin__InfluenzaB__ALA08564

SEQ ID NO: 119943 - RNA, 1755 nt, Artificial Sequence; identical to SEQ ID NO: 119801
  derived and/or modified sequence opt2 from hemagglutinin__InfluenzaB__ALA08565

SEQ ID NO: 119944 - RNA, 1755 nt, Artificial Sequence; identical to SEQ ID NO: 119801
  derived and/or modified sequence opt2 from hemagglutinin__InfluenzaB__ALA08566

SEQ ID NO: 119945 - RNA, 1755 nt, Artificial Sequence; identical to SEQ ID NO: 119801
  derived and/or modified sequence opt2 from hemagglutinin__InfluenzaB__ALA08567

SEQ ID NO: 119946 - RNA, 1755 nt, Artificial Sequence; identical to SEQ ID NO: 119801
  derived and/or modified sequence opt2 from hemagglutinin__InfluenzaB__ALA08568

SEQ ID NO: 119947 - RNA, 1755 nt, Artificial Sequence; identical to SEQ ID NO: 119801
  derived and/or modified sequence opt2 from hemagglutinin__InfluenzaB__ALA08569

SEQ ID NO: 119948 - RNA, 1758 nt, Artificial Sequence
  derived and/or modified sequence opt2 from hemagglutinin__InfluenzaB__ALA08689
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccccaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119949 - RNA, 1758 nt, Artificial Sequence
  derived and/or modified sequence opt2 from hemagglutinin__InfluenzaB__ALA08690
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacaucaccaacggcaacggcuucuucgccaccauggccugggccguccagaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacgaccacaccauccuccucuacuacuccaccgccgccuccucccucgccgucacccucaugaucgccaucuucgucgucuacauggucucccgcgacaacgucuccugcuccaucugccucuga

SEQ ID NO: 119950 - RNA, 1755 nt, Artificial Sequence; identical to SEQ ID NO: 119801
  derived and/or modified sequence opt2 from hemagglutinin__InfluenzaB__ALE31766

SEQ ID NO: 119951 - RNA, 1758 nt, Artificial Sequence
  derived and/or modified sequence opt2 from hemagglutinin__InfluenzaB__ALE31768
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119952 - RNA, 1758 nt, Artificial Sequence
  derived and/or modified sequence opt2 from hemagglutinin__InfluenzaB__ALE31770
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacaucucccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119953 - RNA, 1755 nt, Artificial Sequence; identical to SEQ ID NO: 119801
  derived and/or modified sequence opt2 from hemagglutinin__InfluenzaB__ALE31772

SEQ ID NO: 119954 - RNA, 1755 nt, Artificial Sequence; identical to SEQ ID NO: 119801
  derived and/or modified sequence opt2 from hemagglutinin__InfluenzaB__ALE31773

SEQ ID NO: 119955 - RNA, 1755 nt, Artificial Sequence
  derived and/or modified sequence opt2 from hemagglutinin__InfluenzaB__ALE31884
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccgucugccucuga

SEQ ID NO: 119956 - RNA, 1755 nt, Artificial Sequence
  derived and/or modified sequence opt2 from hemagglutinin__InfluenzaB__ALE31885
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucgucgucuacauggucucccgcgacaacgucuccugcuccaucugccucuga

SEQ ID NO: 119957 - RNA, 1755 nt, Artificial Sequence; identical to SEQ ID NO: 119801
  derived and/or modified sequence opt2 from hemagglutinin__InfluenzaB__ALE31886

SEQ ID NO: 119958 - RNA, 1755 nt, Artificial Sequence
  derived and/or modified sequence opt2 from hemagglutinin__InfluenzaB__ALE31887
augaaggccaucaucguccuccucauggucgucaccuccaacgccgaccgcaucugcaccggcaucaccuccuccaacuccccccacgucgucaagaccgccacccagggcgagaucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119959 - RNA, 1755 nt, Artificial Sequence; identical to SEQ ID NO: 119801
  derived and/or modified sequence opt2 from hemagglutinin__InfluenzaB__ALE31982

SEQ ID NO: 119960 - RNA, 1755 nt, Artificial Sequence
  derived and/or modified sequence opt2 from hemagglutinin__InfluenzaB__ALE31983
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgcccucuucaucgucuacauggucucccgcgacaacgucuccugcuccaucugccucuga

SEQ ID NO: 119961 - RNA, 1755 nt, Artificial Sequence
  derived and/or modified sequence opt2 from hemagglutinin__InfluenzaB__ALE31984
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgaggaggaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119962 - RNA, 1755 nt, Artificial Sequence; identical to SEQ ID NO: 119801
  derived and/or modified sequence opt2 from hemagglutinin__InfluenzaB__ALE31985

SEQ ID NO: 119963 - RNA, 1758 nt, Artificial Sequence
  derived and/or modified sequence opt2 from hemagglutinin__InfluenzaB__ALE31986
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucaucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccgucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119964 - RNA, 1755 nt, Artificial Sequence
  derived and/or modified sequence opt2 from hemagglutinin__InfluenzaB__ALE31988
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119965 - RNA, 1758 nt, Artificial Sequence; identical to SEQ ID NO: 119963
  derived and/or modified sequence opt2 from hemagglutinin__InfluenzaB__ALE31989

SEQ ID NO: 119966 - RNA, 1758 nt, Artificial Sequence; identical to SEQ ID NO: 119963
  derived and/or modified sequence opt2 from hemagglutinin__InfluenzaB__ALE31990

SEQ ID NO: 119967 - RNA, 1755 nt, Artificial Sequence; identical to SEQ ID NO: 119801
  derived and/or modified sequence opt2 from hemagglutinin__InfluenzaB__ALE31991

SEQ ID NO: 119968 - RNA, 1758 nt, Artificial Sequence
  derived and/or modified sequence opt2 from hemagglutinin__InfluenzaB__ALE31992
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagcgcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119969 - RNA, 1758 nt, Artificial Sequence; identical to SEQ ID NO: 119377
  derived and/or modified sequence opt2 from hemagglutinin__InfluenzaB__ALE31993

SEQ ID NO: 119970 - RNA, 1758 nt, Artificial Sequence
  derived and/or modified sequence opt2 from hemagglutinin__InfluenzaB__ALE31994
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucuggguccgcaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119971 - RNA, 1755 nt, Artificial Sequence; identical to SEQ ID NO: 119960
  derived and/or modified sequence opt2 from hemagglutinin__InfluenzaB__ALN39719

SEQ ID NO: 119972 - RNA, 1755 nt, Artificial Sequence; identical to SEQ ID NO: 119801
  derived and/or modified sequence opt2 from hemagglutinin__InfluenzaB__ALN39720

SEQ ID NO: 119973 - RNA, 1755 nt, Artificial Sequence; identical to SEQ ID NO: 119801
  derived and/or modified sequence opt2 from hemagglutinin__InfluenzaB__ALN39721

SEQ ID NO: 119974 - RNA, 1755 nt, Artificial Sequence; identical to SEQ ID NO: 119801
  derived and/or modified sequence opt2 from hemagglutinin__InfluenzaB__ALN39723

SEQ ID NO: 119975 - RNA, 1755 nt, Artificial Sequence; identical to SEQ ID NO: 119801
  derived and/or modified sequence opt2 from hemagglutinin__InfluenzaB__ALN39724

SEQ ID NO: 119976 - RNA, 1755 nt, Artificial Sequence; identical to SEQ ID NO: 119964
  derived and/or modified sequence opt2 from hemagglutinin__InfluenzaB__ALN39725

SEQ ID NO: 119977 - RNA, 1755 nt, Artificial Sequence
  derived and/or modified sequence opt2 from hemagglutinin__InfluenzaB__ALN39726
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccgacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119978 - RNA, 1755 nt, Artificial Sequence; identical to SEQ ID NO: 119964
  derived and/or modified sequence opt2 from hemagglutinin__InfluenzaB__ALN39727

SEQ ID NO: 119979 - RNA, 1755 nt, Artificial Sequence; identical to SEQ ID NO: 119801
  derived and/or modified sequence opt2 from hemagglutinin__InfluenzaB__ALN39728

SEQ ID NO: 119980 - RNA, 1755 nt, Artificial Sequence; identical to SEQ ID NO: 119801
  derived and/or modified sequence opt2 from hemagglutinin__InfluenzaB__ALN39729

SEQ ID NO: 119981 - RNA, 1758 nt, Artificial Sequence
  derived and/or modified sequence opt2 from hemagglutinin__InfluenzaB__ALN39730
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucuuccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119982 - RNA, 1755 nt, Artificial Sequence; identical to SEQ ID NO: 119801
  derived and/or modified sequence opt2 from hemagglutinin__InfluenzaB__ALN39732

SEQ ID NO: 119983 - RNA, 1755 nt, Artificial Sequence
  derived and/or modified sequence opt2 from hemagglutinin__InfluenzaB__ALN39733
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcaccgcugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119984 - RNA, 1755 nt, Artificial Sequence
  derived and/or modified sequence opt2 from hemagglutinin__InfluenzaB__ALN39751
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcauggucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgcccucuucaucgucuacauggucucccgcgacaacgucuccugcuccaucugccucuga

SEQ ID NO: 119985 - RNA, 1755 nt, Artificial Sequence; identical to SEQ ID NO: 119960
  derived and/or modified sequence opt2 from hemagglutinin__InfluenzaB__ALN39752

SEQ ID NO: 119986 - RNA, 1755 nt, Artificial Sequence; identical to SEQ ID NO: 119801
  derived and/or modified sequence opt2 from hemagglutinin__InfluenzaB__ALN39753

SEQ ID NO: 119987 - RNA, 1758 nt, Artificial Sequence
  derived and/or modified sequence opt2 from hemagglutinin__InfluenzaB__ALN39754
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119988 - RNA, 1758 nt, Artificial Sequence
  derived and/or modified sequence opt2 from hemagglutinin__InfluenzaB__ALN39755
augaaggccaucaucguccuccuccucgucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 119989 - RNA, 1755 nt, Artificial Sequence
  derived and/or modified sequence opt2 from hemagglutinin__InfluenzaB__ALN39756
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgucggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119990 - RNA, 1758 nt, Artificial Sequence; identical to SEQ ID NO: 119987
  derived and/or modified sequence opt2 from hemagglutinin__InfluenzaB__ALN39757

SEQ ID NO: 119991 - RNA, 1755 nt, Artificial Sequence; identical to SEQ ID NO: 119801
  derived and/or modified sequence opt2 from hemagglutinin__InfluenzaB__ALN39758

SEQ ID NO: 119992 - RNA, 1755 nt, Artificial Sequence
  derived and/or modified sequence opt2 from hemagglutinin__InfluenzaB__ALN39759
augaagaccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 119993 - RNA, 1758 nt, Artificial Sequence; identical to SEQ ID NO: 119951
  derived and/or modified sequence opt2 from hemagglutinin__InfluenzaB__ALN39760

SEQ ID NO: 119994 - RNA, 1755 nt, Artificial Sequence; identical to SEQ ID NO: 119801
  derived and/or modified sequence opt2 from hemagglutinin__InfluenzaB__ALN39761

SEQ ID NO: 119995 - RNA, 1755 nt, Artificial Sequence; identical to SEQ ID NO: 119801
  derived and/or modified sequence opt2 from hemagglutinin__InfluenzaB__ALN39762

SEQ ID NO: 119996 - RNA, 1755 nt, Artificial Sequence; identical to SEQ ID NO: 119801
  derived and/or modified sequence opt2 from hemagglutinin__InfluenzaB__ALN39763

SEQ ID NO: 119997 - RNA, 1758 nt, Artificial Sequence; identical to SEQ ID NO: 119987
  derived and/or modified sequence opt2 from hemagglutinin__InfluenzaB__ALN39764

SEQ ID NO: 119998 - RNA, 1755 nt, Artificial Sequence
  derived and/or modified sequence opt2 from hemagglutinin__InfluenzaB__ALN39765
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaacaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgcccucuucaucgucuacauggucucccgcgacaacgucuccugcuccaucugccucuga

SEQ ID NO: 119999 - RNA, 1755 nt, Artificial Sequence; identical to SEQ ID NO: 119964
  derived and/or modified sequence opt2 from hemagglutinin__InfluenzaB__ALN39766

SEQ ID NO: 120000 - RNA, 1755 nt, Artificial Sequence; identical to SEQ ID NO: 119801
  derived and/or modified sequence opt2 from hemagglutinin__InfluenzaB__ALN39767

SEQ ID NO: 120001 - RNA, 1755 nt, Artificial Sequence; identical to SEQ ID NO: 119964
  derived and/or modified sequence opt2 from hemagglutinin__InfluenzaB__ALN39768

SEQ ID NO: 120002 - RNA, 1755 nt, Artificial Sequence
  derived and/or modified sequence opt2 from hemagglutinin__InfluenzaB__ALN39769
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacggccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120003 - RNA, 1755 nt, Artificial Sequence; identical to SEQ ID NO: 119960
  derived and/or modified sequence opt2 from hemagglutinin__InfluenzaB__ALN39770

SEQ ID NO: 120004 - RNA, 1755 nt, Artificial Sequence; identical to SEQ ID NO: 119960
  derived and/or modified sequence opt2 from hemagglutinin__InfluenzaB__ALN39771

SEQ ID NO: 120005 - RNA, 1755 nt, Artificial Sequence; identical to SEQ ID NO: 119801
  derived and/or modified sequence opt2 from hemagglutinin__InfluenzaB__ALN39773

SEQ ID NO: 120006 - RNA, 1755 nt, Artificial Sequence; identical to SEQ ID NO: 119801
  derived and/or modified sequence opt2 from hemagglutinin__InfluenzaB__ALN39774

SEQ ID NO: 120007 - RNA, 1758 nt, Artificial Sequence
  derived and/or modified sequence opt2 from hemagglutinin__InfluenzaB__ALN39775
augcaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucaucgacuacaugguccagaaguccggcaagaccggcaccaucaccuaccagcgcggcauccuccucccccagaaggucuggugcgucuccggccgcuccaaggucaucaagggcucccucccccucaucggcgaggccgacugccuccacgagaaguacggcggccucaacaaguccaagcccuacuacaccggcgagcacgccaaggccgucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120008 - RNA, 1755 nt, Artificial Sequence
  derived and/or modified sequence opt2 from hemagglutinin__InfluenzaB__ALN39776
augaaggccaucaucauccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120009 - RNA, 1755 nt, Artificial Sequence; identical to SEQ ID NO: 119964
  derived and/or modified sequence opt2 from hemagglutinin__InfluenzaB__ALN39778

SEQ ID NO: 120010 - RNA, 1758 nt, Artificial Sequence; identical to SEQ ID NO: 119987
  derived and/or modified sequence opt2 from hemagglutinin__InfluenzaB__ALN39779

SEQ ID NO: 120011 - RNA, 1755 nt, Artificial Sequence; identical to SEQ ID NO: 119801
  derived and/or modified sequence opt2 from hemagglutinin__InfluenzaB__ALN39780

SEQ ID NO: 120012 - RNA, 1758 nt, Artificial Sequence; identical to SEQ ID NO: 119987
  derived and/or modified sequence opt2 from hemagglutinin__InfluenzaB__ALN39781

SEQ ID NO: 120013 - RNA, 1758 nt, Artificial Sequence; identical to SEQ ID NO: 119951
  derived and/or modified sequence opt2 from hemagglutinin__InfluenzaB__ALN39782

SEQ ID NO: 120014 - RNA, 1755 nt, Artificial Sequence
  derived and/or modified sequence opt2 from hemagglutinin__InfluenzaB__ALN39783
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaaccuccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120015 - RNA, 1758 nt, Artificial Sequence; identical to SEQ ID NO: 119963
  derived and/or modified sequence opt2 from hemagglutinin__InfluenzaB__ALN39784

SEQ ID NO: 120016 - RNA, 1758 nt, Artificial Sequence; identical to SEQ ID NO: 119987
  derived and/or modified sequence opt2 from hemagglutinin__InfluenzaB__ALN39785

SEQ ID NO: 120017 - RNA, 1755 nt, Artificial Sequence; identical to SEQ ID NO: 119801
  derived and/or modified sequence opt2 from hemagglutinin__InfluenzaB__ALN39786

SEQ ID NO: 120018 - RNA, 1758 nt, Artificial Sequence; identical to SEQ ID NO: 119987
  derived and/or modified sequence opt2 from hemagglutinin__InfluenzaB__ALN39787

SEQ ID NO: 120019 - RNA, 1758 nt, Artificial Sequence; identical to SEQ ID NO: 119987
  derived and/or modified sequence opt2 from hemagglutinin__InfluenzaB__ALN39788

SEQ ID NO: 120020 - RNA, 1755 nt, Artificial Sequence
  derived and/or modified sequence opt2 from hemagglutinin__InfluenzaB__ALN39790
augaaggccaucaucguccuccucauggucgucaccuccgacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagcgcuucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120021 - RNA, 1755 nt, Artificial Sequence
  derived and/or modified sequence opt2 from hemagglutinin__InfluenzaB__ALN39791
augaaggccaucaucguccuccucauggucgucauguccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120022 - RNA, 1758 nt, Artificial Sequence; identical to SEQ ID NO: 119987
  derived and/or modified sequence opt2 from hemagglutinin__InfluenzaB__ALN39792

SEQ ID NO: 120023 - RNA, 1758 nt, Artificial Sequence; identical to SEQ ID NO: 119987
  derived and/or modified sequence opt2 from hemagglutinin__InfluenzaB__ALN39793

SEQ ID NO: 120024 - RNA, 1755 nt, Artificial Sequence
  derived and/or modified sequence opt2 from hemagglutinin__InfluenzaB__ALN39794
augaaggccaucaucauccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccgacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120025 - RNA, 1755 nt, Artificial Sequence; identical to SEQ ID NO: 119964
  derived and/or modified sequence opt2 from hemagglutinin__InfluenzaB__ALN39795

SEQ ID NO: 120026 - RNA, 1758 nt, Artificial Sequence
  derived and/or modified sequence opt2 from hemagglutinin__InfluenzaB__ALN39796
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgccaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120027 - RNA, 1755 nt, Artificial Sequence; identical to SEQ ID NO: 119964
  derived and/or modified sequence opt2 from hemagglutinin__InfluenzaB__ALN39797

SEQ ID NO: 120028 - RNA, 1755 nt, Artificial Sequence
  derived and/or modified sequence opt2 from hemagglutinin__InfluenzaB__ALN39798
augaaggccaucaucguccuccucauggucgucaccuccaacgccgaccgcaucugcaccggcaucaccuccuccuccuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120029 - RNA, 1755 nt, Artificial Sequence; identical to SEQ ID NO: 119801
  derived and/or modified sequence opt2 from hemagglutinin__InfluenzaB__ALN39799

SEQ ID NO: 120030 - RNA, 1755 nt, Artificial Sequence
  derived and/or modified sequence opt2 from hemagglutinin__InfluenzaB__ALN39800
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagaagaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120031 - RNA, 1755 nt, Artificial Sequence; identical to SEQ ID NO: 120021
  derived and/or modified sequence opt2 from hemagglutinin__InfluenzaB__ALN39801

SEQ ID NO: 120032 - RNA, 1755 nt, Artificial Sequence; identical to SEQ ID NO: 119964
  derived and/or modified sequence opt2 from hemagglutinin__InfluenzaB__ALN39802

SEQ ID NO: 120033 - RNA, 1755 nt, Artificial Sequence; identical to SEQ ID NO: 120021
  derived and/or modified sequence opt2 from hemagglutinin__InfluenzaB__ALN39803

SEQ ID NO: 120034 - RNA, 1755 nt, Artificial Sequence; identical to SEQ ID NO: 119960
  derived and/or modified sequence opt2 from hemagglutinin__InfluenzaB__ALN39804

SEQ ID NO: 120035 - RNA, 1758 nt, Artificial Sequence; identical to SEQ ID NO: 119987
  derived and/or modified sequence opt2 from hemagglutinin__InfluenzaB__ALN39805

SEQ ID NO: 120036 - RNA, 1758 nt, Artificial Sequence; identical to SEQ ID NO: 118501
  derived and/or modified sequence opt2 from hemagglutinin__InfluenzaB__ACN29380

SEQ ID NO: 120037 - RNA, 1758 nt, Artificial Sequence; identical to SEQ ID NO: 118833
  derived and/or modified sequence opt2 from hemagglutinin__InfluenzaB__EPI498048

SEQ ID NO: 120038 - RNA, 1758 nt, Artificial Sequence
  derived and/or modified sequence opt2 from hemagglutinin__InfluenzaB__ANC28539
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgaggcccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120039 - RNA, 1758 nt, Artificial Sequence
  derived and/or modified sequence opt2 from hemagglutinin__InfluenzaB__EPI827073
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggccuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120040 - RNA, 1758 nt, Artificial Sequence; identical to SEQ ID NO: 118259
  derived and/or modified sequence opt2 from hemagglutinin__InfluenzaB__EPI244699

SEQ ID NO: 120041 - RNA, 1758 nt, Artificial Sequence; identical to SEQ ID NO: 118252
  derived and/or modified sequence opt2 from hemagglutinin__InfluenzaB__EPI244702

SEQ ID NO: 120042 - RNA, 1755 nt, Artificial Sequence; identical to SEQ ID NO: 119641
  derived and/or modified sequence opt2 from hemagglutinin__InfluenzaB__EPI540671

SEQ ID NO: 120043 - RNA, 1755 nt, Artificial Sequence
  derived and/or modified sequence opt2 from hemagglutinin__InfluenzaB__EPI573303
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacgacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120044 - RNA, 1755 nt, Artificial Sequence
  derived and/or modified sequence opt2 from hemagglutinin__InfluenzaB__EPI829466
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacgacaagacccagaugaagucccucuacggcgacuccaacccccagaaguucaccuccuccgccaacggcgucaccacccacuacgucucccagaucggcgacuuccccgaccagaccgaggacgagggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120045 - RNA, 1755 nt, Artificial Sequence
  derived and/or modified sequence opt2 from hemagglutinin__InfluenzaB__EPI684429
augaaggccaucaucguccuccucauggucgucauguccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgucuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120046 - RNA, 1758 nt, Artificial Sequence; identical to SEQ ID NO: 118264
  derived and/or modified sequence opt2 from hemagglutinin__InfluenzaB__AFH58447

SEQ ID NO: 120047 - RNA, 1758 nt, Artificial Sequence
  derived and/or modified sequence opt2 from hemagglutinin__InfluenzaB__EPI173279
augaaggccaucaucgucauccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacuccgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120048 - RNA, 1758 nt, Artificial Sequence; identical to SEQ ID NO: 118833
  derived and/or modified sequence opt2 from hemagglutinin__InfluenzaB__EPI163726

SEQ ID NO: 120049 - RNA, 1758 nt, Artificial Sequence; identical to SEQ ID NO: 119987
  derived and/or modified sequence opt2 from hemagglutinin__InfluenzaB__EPI636340

SEQ ID NO: 120050 - RNA, 1758 nt, Artificial Sequence
  derived and/or modified sequence opt2 from hemagglutinin__InfluenzaB__EPI645995
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgaggacgcccccggcggccccuacaagaucggcaccuccggcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120051 - RNA, 1755 nt, Artificial Sequence; identical to SEQ ID NO: 119641
  derived and/or modified sequence opt2 from hemagglutinin__InfluenzaB__EPI539769

SEQ ID NO: 120052 - RNA, 1755 nt, Artificial Sequence; identical to SEQ ID NO: 120043
  derived and/or modified sequence opt2 from hemagglutinin__InfluenzaB__EPI551249

SEQ ID NO: 120053 - RNA, 1755 nt, Artificial Sequence
  derived and/or modified sequence opt2 from hemagglutinin__InfluenzaB__EPI544259
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagaaccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120054 - RNA, 1755 nt, Artificial Sequence
  derived and/or modified sequence opt2 from hemagglutinin__InfluenzaB__EPI592699
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagauccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120055 - RNA, 1755 nt, Artificial Sequence; identical to SEQ ID NO: 119964
  derived and/or modified sequence opt2 from hemagglutinin__InfluenzaB__EPI592707

SEQ ID NO: 120056 - RNA, 1755 nt, Artificial Sequence
  derived and/or modified sequence opt2 from hemagglutinin__InfluenzaB__EPI693094
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccgaguccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagauccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120057 - RNA, 1758 nt, Artificial Sequence; identical to SEQ ID NO: 119987
  derived and/or modified sequence opt2 from hemagglutinin__InfluenzaB__EPI678796

SEQ ID NO: 120058 - RNA, 1758 nt, Artificial Sequence
  derived and/or modified sequence opt2 from hemagglutinin__InfluenzaB__EPI721064
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacguccgccucuccacccacaacgucaucaacgccgaggacgcccccggcggccccuacaagaucggcaccucccgcuccugccccaacaucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120059 - RNA, 1758 nt, Artificial Sequence; identical to SEQ ID NO: 118268
  derived and/or modified sequence opt2 from hemagglutinin__InfluenzaB__EPI328904

SEQ ID NO: 120060 - RNA, 1755 nt, Artificial Sequence
  derived and/or modified sequence opt2 from hemagglutinin__InfluenzaB__EPI543191
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaagaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120061 - RNA, 1755 nt, Artificial Sequence; identical to SEQ ID NO: 119641
  derived and/or modified sequence opt2 from hemagglutinin__InfluenzaB__EPI500359

SEQ ID NO: 120062 - RNA, 1755 nt, Artificial Sequence
  derived and/or modified sequence opt2 from hemagglutinin__InfluenzaB__EPI543185
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccagaccgucgagguccccuacaucugcaccgagggcgaggaccagaucaccgucuggggcuuccacuccgacaacaagaaccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120063 - RNA, 1755 nt, Artificial Sequence; identical to SEQ ID NO: 119801
  derived and/or modified sequence opt2 from hemagglutinin__InfluenzaB__EPI536447

SEQ ID NO: 120064 - RNA, 1755 nt, Artificial Sequence; identical to SEQ ID NO: 118270
  derived and/or modified sequence opt2 from hemagglutinin__InfluenzaB__NP_056660

SEQ ID NO: 120065 - RNA, 1755 nt, Artificial Sequence
  derived and/or modified sequence opt2 from hemagglutinin__InfluenzaB__ABG85167
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccacccgcucccacuucgccaaccucaagggcacccagacccgcggcaagcucugccccaacugcuucaacugcaccgaccucgacgucgcccucggccgccccaagugcaugggcaacauccccuccgccaaggucuccauccuccacgaggucaagcccgucaccuccggcugcuuccccaucaugcacgaccgcaccaagauccgccagcuccccaaccuccuccgcggcuacgagaacauccgccucuccaccuccaacgucaucaacgccgagaccgcccccggcggccccuacaaggucggcaccuccggcuccugccccaacgucgccaaccgcaacggcuucuucaacaccauggccugggucauccccaaggacaacaacaagaccgccaucaaccccgucaccgucgagguccccuacaucugcuccgagggcgaggaccagaucaccgucuggggcuuccacuccgacgacaagacccagauggagcgccucuacggcgacuccaacccccagaaguucaccuccuccgccaacggcgucaccacccacuacgucucccagaucggcggcuuccccaaccagaccgaggacgagggccucaagcaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccaugaacggccuccacgacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacgaccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 120066 - RNA, 1755 nt, Artificial Sequence
  derived and/or modified sequence opt2 from hemagglutinin__InfluenzaB__EPI376346
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcgccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120067 - RNA, 1755 nt, Artificial Sequence; identical to SEQ ID NO: 118366
  derived and/or modified sequence opt2 from hemagglutinin__InfluenzaB__EPI368425

SEQ ID NO: 120068 - RNA, 1755 nt, Artificial Sequence; identical to SEQ ID NO: 118332
  derived and/or modified sequence opt2 from hemagglutinin__InfluenzaB__ACH53430

SEQ ID NO: 120069 - RNA, 1758 nt, Artificial Sequence; identical to SEQ ID NO: 118157
  derived and/or modified sequence opt2 from hemagglutinin__InfluenzaB__EPI331151

SEQ ID NO: 120070 - RNA, 1758 nt, Artificial Sequence
  derived and/or modified sequence opt2 from hemagglutinin__InfluenzaB__EPI356777
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacgacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120071 - RNA, 1752 nt, Artificial Sequence; identical to SEQ ID NO: 117939
  derived and/or modified sequence opt2 from hemagglutinin__InfluenzaB__CY018349

SEQ ID NO: 120072 - RNA, 1752 nt, Artificial Sequence
  derived and/or modified sequence opt2 from hemagglutinin__InfluenzaB__AY581945
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaacugccucaacugcaccgaccucgacgucgcccucgcccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucaacgccgagcgcgcccccggcggccccuaccgccucggcaccuccggcuccugccccaacgucaccucccgcgacggcuucuucgccaccauggccugggccgucccccgcgacaacaagaccgccaccaacccccucaccgucgagguccccuacaucugcaccaagggcgaggaccagaucaccgucuggggcuuccacuccgacaacaagacccagaugaagaaccucuacggcgacuccaacccccagaaguucaccuccuccgccaacggcgucaccacccacuacgucucccagaucggcggcuuccccaaccagaccgaggacggcggccucccccaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 120073 - RNA, 1755 nt, Artificial Sequence; identical to SEQ ID NO: 119820
  derived and/or modified sequence opt2 from hemagglutinin__InfluenzaB__EPI541351

SEQ ID NO: 120074 - RNA, 1755 nt, Artificial Sequence
  derived and/or modified sequence opt2 from hemagglutinin__InfluenzaB__EPI541760
augaaggccgucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120075 - RNA, 1758 nt, Artificial Sequence; identical to SEQ ID NO: 118399
  derived and/or modified sequence opt2 from hemagglutinin__InfluenzaB__EPI477397

SEQ ID NO: 120076 - RNA, 1758 nt, Artificial Sequence
  derived and/or modified sequence opt2 from hemagglutinin__InfluenzaB__EPI492571
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaucgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120077 - RNA, 1758 nt, Artificial Sequence
  derived and/or modified sequence opt2 from hemagglutinin__InfluenzaB__EPI498340
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacaccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaucgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120078 - RNA, 1758 nt, Artificial Sequence
  derived and/or modified sequence opt2 from hemagglutinin__InfluenzaB__EPI516490
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaagauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgaggacgcccccggcggccccuacaagaucggcaccuccggcuccugccccaacgucaccaacggcaacggcuucuucgccaccauggccugggccguccccaagaacgacaagaacaagaccgccaccaacccccucaccaucgagguccccuacaucugcaccgagggcgaggaccagaucaccgucuggggcuuccacuccgacaacgagauccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccucuga

SEQ ID NO: 120079 - RNA, 1755 nt, Artificial Sequence; identical to SEQ ID NO: 119641
  derived and/or modified sequence opt2 from hemagglutinin__InfluenzaB__EPI538119

SEQ ID NO: 120080 - RNA, 1755 nt, Artificial Sequence; identical to SEQ ID NO: 120060
  derived and/or modified sequence opt2 from hemagglutinin__InfluenzaB__EPI538125

SEQ ID NO: 120081 - RNA, 1755 nt, Artificial Sequence
  derived and/or modified sequence opt2 from hemagglutinin__InfluenzaB__EPI556422
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaucaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120082 - RNA, 1755 nt, Artificial Sequence
  derived and/or modified sequence opt2 from hemagglutinin__InfluenzaB__EPI614608
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccaucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacgagaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120083 - RNA, 1755 nt, Artificial Sequence
  derived and/or modified sequence opt2 from hemagglutinin__InfluenzaB__EPI614610
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaagauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacgagaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgaggaguacggcggccucaacaaguccaagcccuacuacaccggcaagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120084 - RNA, 1758 nt, Artificial Sequence
  derived and/or modified sequence opt2 from hemagglutinin__InfluenzaB__AAA43697
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccaagacccgcggcaagcucugccccaagugccucaacugcaccgaccucgacgucgcccucgcccgccccaagugcaugggcaccauccccuccgccaaggccuccauccuccacgaggucaagcccgucaccuccggcugcuuccccaucaugcacgaccgcaccaagauccgccagcuccccaaccuccuccgcggcuacgagcacauccgccucuccacccacaacgucaucaacgccgagaccgcccccggcggccccuacaaggucggcaccuccggcuccugccccaacgucaccaacggcaacggcuucuucgccaccauggccugggccguccccaagaacgacaacaacaagaccgccaccaacccccucaccgucgagguccccuacaucugcaccgagggcgaggaccagaucaccgucuggggcuuccacuccgacuccgagacccagauggucaagcucuacggcgacuccaagccccagaaguucaccuccuccgccaacggcgucaccacccacuacgucucccagaucggcggcuuccccaaccaggccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccucuga

SEQ ID NO: 120085 - RNA, 1755 nt, Artificial Sequence
  derived and/or modified sequence opt2 from hemagglutinin__InfluenzaB__EPI271545
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagacccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120086 - RNA, 1755 nt, Artificial Sequence
  derived and/or modified sequence opt2 from hemagglutinin__InfluenzaB__AGB08329
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaagaucggcuucuucgccaccauggccugggccguccccaaggacaacuacaagaacgccaccaacccccucaccgucgagguccccuacaucugcaccgagggcgaggaccagaucaccgucuggggcuuccacuccgacaacaagauccagaugaagucccucuacggcgacuccaacccccagaaguucaccuccuccgccaacggcgucaccacccacuacgucucccagaucggcgacuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccucuga

SEQ ID NO: 120087 - RNA, 1755 nt, Artificial Sequence; identical to SEQ ID NO: 118267
  derived and/or modified sequence opt2 from hemagglutinin__InfluenzaB__EPI294880

SEQ ID NO: 120088 - RNA, 1752 nt, Artificial Sequence; identical to SEQ ID NO: 117978
  derived and/or modified sequence opt2 from hemagglutinin__InfluenzaB__CY018765

SEQ ID NO: 120089 - RNA, 1401 nt, Artificial Sequence
  derived and/or modified sequence opt2 from neuraminidase_glycoprotein__InfluenzaB__AAN39743
augcuccccuccaccauccagacccucacccucuuccucaccuccggcggcguccuccucucccucuacgucuccgcccuccucuccuaccuccucuacuccgacauccuccucaaguucucccccaccaaggucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcauccacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcaucaucaaggagaucuuccccaccggccgcgucgagcacaccgaggagugcaccugcggcuucgccuccaacaagaccaucgagugcgucugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcaacggcggcaucaagggcggcuucguccaccagcgcauggccucccgcaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120090 - RNA, 1401 nt, Artificial Sequence
  derived and/or modified sequence opt2 from neuraminidase_glycoprotein__InfluenzaB__AAN39747
augcuccccuccaccauccagacccucauccucuuccucaccuccggcggcguccuccucucccucuacgucuccgcccuccucuccuaccuccucuacuccgacauccuccucaaguucucccccaccaagaucaucgcccccaccaugucccucgacugcgccaacgccuccaacguccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccaucgaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120091 - RNA, 1401 nt, Artificial Sequence
  derived and/or modified sequence opt2 from neuraminidase_glycoprotein__InfluenzaB__AAN39749
augcuccccuccaccauccagacccucacccucuuccucaccuccggcggcguccuccucucccucuacgucuccgcccuccucuccuaccuccucuacuccgacauccuccucaaguucucccccaccaaggucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcaacggcggcaucaagggcggcuucguccaccagcgcauggccucccgcaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120092 - RNA, 1401 nt, Artificial Sequence
  derived and/or modified sequence opt2 from neuraminidase_glycoprotein__InfluenzaB__AAN39751
augcuccccuccaccauccagacccucacccucuuccucaccuccggcggcguccuccucucccucuacgucuccgcccuccucuccuaccuccucuacuccgacauccuccucaaguucucccccaccaaggucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcauccucaaggagaucuuccccaccggccgcgucgagcacaccgaggagugcaccugcggcuucgccuccaacaagaccaucgagugcgccugccgcgacaacuccuacaccgccaagcgccccuucguccagcucaacgucgagaccgacaccgccgagauccgccucaugugcaccgagaccuaccucgacaccccccgccccgacgacggcuccaucaccggccccugcgaguccaacggcgacaagggcaacggcggcaucaagggcggcuucguccaccagcgcauggccucccgcaucggccgcugguacucccgcaccauguccaagaccaagcgcaugggcauggaccucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120093 - RNA, 1401 nt, Artificial Sequence
  derived and/or modified sequence opt2 from neuraminidase_glycoprotein__InfluenzaB__AAN39753
augcuccccuccaccauccagacccucacccucuuccucaccuccggcggcguccuccucucccucuacgucuccgcccuccucuccuaccuccucuacuccgacauccuccucaaguucucccccaccaaggucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcgaguacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcaacggcggcaucaagggcggcuucguccaccagcgcauggccucccgcaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120094 - RNA, 1401 nt, Artificial Sequence
  derived and/or modified sequence opt2 from neuraminidase_glycoprotein__InfluenzaB__AAN39759
augcuccccuccaccauccagacccucacccucuuccucaccuccggcggcguccuccucucccucuacgucuccgccucccucuccuaccuccucuacuccgacauccuccucaagcucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccaagcgcaugggcaugggccucuacgucaaguacgacggcgaccccuggaccgacuccgacgcccucgcccucuccggcgucauggucuccaucgaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120095 - RNA, 1401 nt, Artificial Sequence
  derived and/or modified sequence opt2 from neuraminidase_glycoprotein__InfluenzaB__AAN39761
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120096 - RNA, 1401 nt, Artificial Sequence
  derived and/or modified sequence opt2 from neuraminidase_glycoprotein__InfluenzaB__AAN39769
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120097 - RNA, 1401 nt, Artificial Sequence
  derived and/or modified sequence opt2 from neuraminidase_glycoprotein__InfluenzaB__AAN39771
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucgucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgaccccuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccaucaccggcgucgacauggcccucuga

SEQ ID NO: 120098 - RNA, 1401 nt, Artificial Sequence
  derived and/or modified sequence opt2 from neuraminidase_glycoprotein__InfluenzaB__AAN39773
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaacuucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucgucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccaucaccggcgucgacauggcccucuga

SEQ ID NO: 120099 - RNA, 1401 nt, Artificial Sequence
  derived and/or modified sequence opt2 from neuraminidase_glycoprotein__InfluenzaB__AAN39775
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggcaaggaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120100 - RNA, 1401 nt, Artificial Sequence
  derived and/or modified sequence opt2 from neuraminidase_glycoprotein__InfluenzaB__AAN39777
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120101 - RNA, 1401 nt, Artificial Sequence; identical to SEQ ID NO: 120096
  derived and/or modified sequence opt2 from neuraminidase_glycoprotein__InfluenzaB__AAN39779

SEQ ID NO: 120102 - RNA, 1401 nt, Artificial Sequence
  derived and/or modified sequence opt2 from neuraminidase_glycoprotein__InfluenzaB__AAN39781
augcuccccuccaccauccagacccucacccucuuccucaccuccggcggcguccuccucucccucuacgucuccgccucccucuccuaccuccucuacuccgacauccuccucaaguucuccuccaccgagaucaccgcccccaccaugccccucaacugcgccaacgccuccaacguccaggccgucaaccacuccgccaccaagggcgucacccucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcgucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaacaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120103 - RNA, 1401 nt, Artificial Sequence
  derived and/or modified sequence opt2 from neuraminidase_glycoprotein__InfluenzaB__AAN39783
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120104 - RNA, 1401 nt, Artificial Sequence
  derived and/or modified sequence opt2 from neuraminidase_glycoprotein__InfluenzaB__AAN39785
augcuccccuccaccauccagacccucacccucuuccucaccuccggcggcguccuccucucccucuacgucuccgcccuccucuccuaccuccucuacuccgacauccuccucaaguucucccccaccaaggucaucgcccccaccaugucccucgacuacgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcaugaccucccgcaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120105 - RNA, 1401 nt, Artificial Sequence
  derived and/or modified sequence opt2 from neuraminidase_glycoprotein__InfluenzaB__AAN39787
augcuccccuccaccauccagacccucacccucuuccucaccuccggcggcguccuccucucccucuacgucuccgcccuccucuccuaccuccucuacuccgacauccuccucaaguucucccccaccaaggucaucgcccccaccaugucccucgacuacgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcaacggcggcaucaagggcggcuucguccaccagcgcauggccucccgcaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120106 - RNA, 1401 nt, Artificial Sequence
  derived and/or modified sequence opt2 from neuraminidase_glycoprotein__InfluenzaB__AAN39795
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaccuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacaacuacaccgccaagcgccccuucgucaagcucaacgucgagaccgacgccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120107 - RNA, 1401 nt, Artificial Sequence; identical to SEQ ID NO: 120091
  derived and/or modified sequence opt2 from neuraminidase_glycoprotein__InfluenzaB__AAN39797

SEQ ID NO: 120108 - RNA, 1401 nt, Artificial Sequence
  derived and/or modified sequence opt2 from neuraminidase_glycoprotein__InfluenzaB__AAN39799
augcuccccuccaccauccagacccucacccucuuccucaccuccggcggcguccuccucucccucuacgucuccgcccuccucuccuaccuccucuacuccgacguccuccucaaguucucccccaccaagaucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucgaguacggcgaggccuacaccgacaccuaccacuccuacgccuacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120109 - RNA, 1401 nt, Artificial Sequence
  derived and/or modified sequence opt2 from neuraminidase_glycoprotein__InfluenzaB__AAN39801
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacgcccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120110 - RNA, 1401 nt, Artificial Sequence
  derived and/or modified sequence opt2 from neuraminidase_glycoprotein__InfluenzaB__AAN39803
augcuccccuccaccauccagacccucacccucuuccucaccuccggcggcguccuccucucccucuacgucuccgccucccucuccuaccuccucuacuccgacauccuccucaaguucucccccaccgagaucaccgcccccaaggucccccucgacugcgccaacgccuccaacguccaggccgucaaccgcuccgccaccaagggcaugacccuccuccucuccgagcccgaguggaccuacccccgccucuccugccagggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggccucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccccuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120111 - RNA, 1401 nt, Artificial Sequence
  derived and/or modified sequence opt2 from neuraminidase__InfluenzaB__ABA02232
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgagaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120112 - RNA, 1401 nt, Artificial Sequence
  derived and/or modified sequence opt2 from neuraminidase__InfluenzaB__ABI84039
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaaguacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120113 - RNA, 1401 nt, Artificial Sequence
  derived and/or modified sequence opt2 from neuraminidase__InfluenzaB__ABI84051
augcuccccuccaccauccagacccucacccucuuccucaccuccggcggcguccuccucucccucuacgucuccgccucccucuccuaccuccucuacuccgacauccuccuccgcuucucccagaccgagaucaccgcccccaucaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120114 - RNA, 1401 nt, Artificial Sequence
  derived and/or modified sequence opt2 from neuraminidase__InfluenzaB__ABI84062
augcuccccuccaccauccagacccucacccucuuccucaccuccggcggcguccuccucucccucuacgucuccgccucccucuccuaccuccucuacuccgacauccuccucaaguucucccccaccgagaucaucgcccccaucaugccccucgacugcgccaacgccuccaacguccaggccgucaaccgcuccaccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120115 - RNA, 1401 nt, Artificial Sequence
  derived and/or modified sequence opt2 from neuraminidase__InfluenzaB__ABL76280
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucaacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120116 - RNA, 1401 nt, Artificial Sequence
  derived and/or modified sequence opt2 from neuraminidase__InfluenzaB__ABL76302
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacccccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagaugcucugggacaccgucaccggcgucgacauggcccucuga

SEQ ID NO: 120117 - RNA, 1401 nt, Artificial Sequence
  derived and/or modified sequence opt2 from neuraminidase__InfluenzaB__ABL76313
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucaacugcgccaacgccuccaacguccaggccgucaaccgcuccgccaccaagggcgucaccuucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccgucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120118 - RNA, 1401 nt, Artificial Sequence
  derived and/or modified sequence opt2 from neuraminidase__InfluenzaB__ABL76335
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucaacugcgccaacgccuccaacguccaggccgucaaccgcuccgccaccaagggcgucacccucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120119 - RNA, 1401 nt, Artificial Sequence
  derived and/or modified sequence opt2 from neuraminidase__InfluenzaB__ABL76346
augcuccccuccaccauccagacccucacccucuuccucaccuccggcggcguccuccucucccucuacgucuccgccucccucuccuaccuccucuacuccgacauccuccucaaguucucccccaaggagaucaccacccccaccaugccccucaacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120120 - RNA, 1401 nt, Artificial Sequence; identical to SEQ ID NO: 120119
  derived and/or modified sequence opt2 from neuraminidase__InfluenzaB__ABL76357

SEQ ID NO: 120121 - RNA, 1401 nt, Artificial Sequence
  derived and/or modified sequence opt2 from neuraminidase__InfluenzaB__ABL76368
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccggcgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120122 - RNA, 1404 nt, Artificial Sequence
  derived and/or modified sequence opt2 from neuraminidase__InfluenzaB__ABL76379
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120123 - RNA, 1401 nt, Artificial Sequence
  derived and/or modified sequence opt2 from neuraminidase__InfluenzaB__ABL76390
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccuccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggcuccugcgaguccgacggcgacaagggcuccggcggcaucaagggcggcuucguccaccagcgcauggccuccaagaucggccgcugguacucccgcaccauguccaagaccaagcgcaugggcaugggccucuacguccgcuacgacggcgaccccuggaccgacuccuccgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120124 - RNA, 1401 nt, Artificial Sequence
  derived and/or modified sequence opt2 from neuraminidase__InfluenzaB__ABL76412
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccucauccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacaccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120125 - RNA, 1401 nt, Artificial Sequence
  derived and/or modified sequence opt2 from neuraminidase__InfluenzaB__ABL76423
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120126 - RNA, 1401 nt, Artificial Sequence
  derived and/or modified sequence opt2 from neuraminidase__InfluenzaB__ABL76434
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120127 - RNA, 1401 nt, Artificial Sequence
  derived and/or modified sequence opt2 from neuraminidase__InfluenzaB__ABL76456
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaagcuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120128 - RNA, 1401 nt, Artificial Sequence
  derived and/or modified sequence opt2 from neuraminidase__InfluenzaB__ABL76467
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120129 - RNA, 1401 nt, Artificial Sequence
  derived and/or modified sequence opt2 from neuraminidase__InfluenzaB__ABL76478
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaagcuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120130 - RNA, 1401 nt, Artificial Sequence
  derived and/or modified sequence opt2 from neuraminidase__InfluenzaB__ABL76522
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120131 - RNA, 1401 nt, Artificial Sequence
  derived and/or modified sequence opt2 from neuraminidase__InfluenzaB__ABL76533
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120132 - RNA, 1401 nt, Artificial Sequence
  derived and/or modified sequence opt2 from neuraminidase__InfluenzaB__ABL76544
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgagcgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120133 - RNA, 1401 nt, Artificial Sequence; identical to SEQ ID NO: 120131
  derived and/or modified sequence opt2 from neuraminidase__InfluenzaB__ABL76566

SEQ ID NO: 120134 - RNA, 1401 nt, Artificial Sequence
  derived and/or modified sequence opt2 from neuraminidase__InfluenzaB__ABL76588
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacuacgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120135 - RNA, 1401 nt, Artificial Sequence; identical to SEQ ID NO: 120130
  derived and/or modified sequence opt2 from neuraminidase__InfluenzaB__ABL76599

SEQ ID NO: 120136 - RNA, 1401 nt, Artificial Sequence; identical to SEQ ID NO: 120130
  derived and/or modified sequence opt2 from neuraminidase__InfluenzaB__ABL76610

SEQ ID NO: 120137 - RNA, 1401 nt, Artificial Sequence
  derived and/or modified sequence opt2 from neuraminidase__InfluenzaB__ABL76621
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgagaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacauccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120138 - RNA, 1401 nt, Artificial Sequence
  derived and/or modified sequence opt2 from neuraminidase__InfluenzaB__ABL76632
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagaugcgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccgucuacugccucaugggcuccggccagcuccucugggacaccgucaccggcgucgacauggcccucuga

SEQ ID NO: 120139 - RNA, 1401 nt, Artificial Sequence
  derived and/or modified sequence opt2 from neuraminidase__InfluenzaB__ABL76643
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120140 - RNA, 1401 nt, Artificial Sequence
  derived and/or modified sequence opt2 from neuraminidase__InfluenzaB__ABL76654
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccaccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120141 - RNA, 1401 nt, Artificial Sequence
  derived and/or modified sequence opt2 from neuraminidase__InfluenzaB__ABL76665
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguucgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120142 - RNA, 1401 nt, Artificial Sequence
  derived and/or modified sequence opt2 from neuraminidase__InfluenzaB__ABL76676
augcuccccuccaccauccagacccucacccucuuccucaccuccggcggcguccuccucucccucuacgucuccgccucccucuccuaccuccucuacuccgacauccuccucaaguucucccagaccggcaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120143 - RNA, 1401 nt, Artificial Sequence
  derived and/or modified sequence opt2 from neuraminidase__InfluenzaB__ABL76687
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguucgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugguccccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120144 - RNA, 1401 nt, Artificial Sequence
  derived and/or modified sequence opt2 from neuraminidase__InfluenzaB__ABL76698
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcaugacccuccuccuccccgagcccgaguggaccuacccccgccucuccugccccggcuccaccuuccagaaggcccuccucaucuccccccaccgcuucggcgagacccgcggcaacuccgccccccucaccauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgaggcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120145 - RNA, 1401 nt, Artificial Sequence
  derived and/or modified sequence opt2 from neuraminidase__InfluenzaB__ABL76720
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcgcuccgccgccaccgccaucuacugccucaugggcuccggccagcuccucugggacaccgucaccggcgucgacauggcccucuga

SEQ ID NO: 120146 - RNA, 1401 nt, Artificial Sequence
  derived and/or modified sequence opt2 from neuraminidase__InfluenzaB__ABL76731
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgccaucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120147 - RNA, 1401 nt, Artificial Sequence
  derived and/or modified sequence opt2 from neuraminidase__InfluenzaB__ABL76742
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120148 - RNA, 1401 nt, Artificial Sequence
  derived and/or modified sequence opt2 from neuraminidase__InfluenzaB__ABL76753
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaccggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacaacaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120149 - RNA, 1401 nt, Artificial Sequence; identical to SEQ ID NO: 120118
  derived and/or modified sequence opt2 from neuraminidase__InfluenzaB__ABL76764

SEQ ID NO: 120150 - RNA, 1401 nt, Artificial Sequence; identical to SEQ ID NO: 120118
  derived and/or modified sequence opt2 from neuraminidase__InfluenzaB__ABL76775

SEQ ID NO: 120151 - RNA, 1401 nt, Artificial Sequence
  derived and/or modified sequence opt2 from neuraminidase__InfluenzaB__ABL76797
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120152 - RNA, 1401 nt, Artificial Sequence
  derived and/or modified sequence opt2 from neuraminidase__InfluenzaB__ABL76819
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120153 - RNA, 1401 nt, Artificial Sequence
  derived and/or modified sequence opt2 from neuraminidase__InfluenzaB__ABL76830
augcuccccuccaccauccagacccucacccucuuccucaccuccggcggcguccuccucucccucuacgucuccgccucccucuccuaccuccucuacuccgacauccuccucaaguucucccccaccaagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120154 - RNA, 1401 nt, Artificial Sequence
  derived and/or modified sequence opt2 from neuraminidase__InfluenzaB__ABL76852
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccaagcgcaugggcaugggccucuacgucaaguacgacggcgaccccuggaccgacuccgacgcccucgcccucuccggcgucauggucuccaucgaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120155 - RNA, 1401 nt, Artificial Sequence
  derived and/or modified sequence opt2 from neuraminidase__InfluenzaB__ABL76863
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggccauguga

SEQ ID NO: 120156 - RNA, 1401 nt, Artificial Sequence
  derived and/or modified sequence opt2 from neuraminidase__InfluenzaB__ABL76874
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaacuccuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagaucaagcucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120157 - RNA, 1401 nt, Artificial Sequence
  derived and/or modified sequence opt2 from neuraminidase__InfluenzaB__ABL76885
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacuacgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120158 - RNA, 1401 nt, Artificial Sequence
  derived and/or modified sequence opt2 from neuraminidase__InfluenzaB__ABL76896
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggauguacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacgccgucaccggcgucgacauggcccucuga

SEQ ID NO: 120159 - RNA, 1401 nt, Artificial Sequence
  derived and/or modified sequence opt2 from neuraminidase__InfluenzaB__ABL76918
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucaucggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120160 - RNA, 1401 nt, Artificial Sequence
  derived and/or modified sequence opt2 from neuraminidase__InfluenzaB__ABL76962
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120161 - RNA, 1401 nt, Artificial Sequence; identical to SEQ ID NO: 120091
  derived and/or modified sequence opt2 from neuraminidase__InfluenzaB__ABL76973

SEQ ID NO: 120162 - RNA, 1401 nt, Artificial Sequence
  derived and/or modified sequence opt2 from neuraminidase__InfluenzaB__ABL76984
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccucuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagcgcaccuggcacuccgccgccaccgccaucuacugccucaugggcuccggccagcuccucugggacaccgucaccggcgucgacauggcccucuga

SEQ ID NO: 120163 - RNA, 1401 nt, Artificial Sequence; identical to SEQ ID NO: 120118
  derived and/or modified sequence opt2 from neuraminidase__InfluenzaB__ABL77006

SEQ ID NO: 120164 - RNA, 1401 nt, Artificial Sequence; identical to SEQ ID NO: 120162
  derived and/or modified sequence opt2 from neuraminidase__InfluenzaB__ABL77017

SEQ ID NO: 120165 - RNA, 1401 nt, Artificial Sequence
  derived and/or modified sequence opt2 from neuraminidase__InfluenzaB__ABL77028
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120166 - RNA, 1401 nt, Artificial Sequence
  derived and/or modified sequence opt2 from neuraminidase__InfluenzaB__ABL77039
augcuccccuccaccauccagacccucacccucuuccucaccuccggcggcguccuccucucccucuacgucuccgccucccucuccuaccuccucuacuccgacauccuccucaaguucucccccaccgagaccaccgcccccaccaugccccucgacugcgccaacgccuccaacguccaggccgucaacugcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120167 - RNA, 1401 nt, Artificial Sequence
  derived and/or modified sequence opt2 from neuraminidase__InfluenzaB__ABL77050
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120168 - RNA, 1401 nt, Artificial Sequence
  derived and/or modified sequence opt2 from neuraminidase__InfluenzaB__ABL77072
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccaucaaggaguccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120169 - RNA, 1401 nt, Artificial Sequence; identical to SEQ ID NO: 120096
  derived and/or modified sequence opt2 from neuraminidase__InfluenzaB__ABL77083

SEQ ID NO: 120170 - RNA, 1401 nt, Artificial Sequence; identical to SEQ ID NO: 120096
  derived and/or modified sequence opt2 from neuraminidase__InfluenzaB__ABL77094

SEQ ID NO: 120171 - RNA, 1401 nt, Artificial Sequence
  derived and/or modified sequence opt2 from neuraminidase__InfluenzaB__ABL77105
augcuccccuccaccauccagacccucacccucuuccucaccuccggcggcguccuccucucccucuacgucuccgccucccucuccuaccuccucuacuccgacauccuccucaaguucuccuccaccgagaucaccgcccccaccaugccccucgacugcgccaacgccuccaacguccaggccgucaaccgcuccgccaccgagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120172 - RNA, 1401 nt, Artificial Sequence; identical to SEQ ID NO: 120096
  derived and/or modified sequence opt2 from neuraminidase__InfluenzaB__ABL77127

SEQ ID NO: 120173 - RNA, 1401 nt, Artificial Sequence
  derived and/or modified sequence opt2 from neuraminidase__InfluenzaB__ABL77138
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccaucgaggagcccggcugguacuccuucggcuucgagaucaaggacaagaagugcgacguccccugcaucggcaucgagaugguccacgacggcggcaagaccaccugguacuccgccgccaccgccaucuacugccucaugggcuccggccagcuccucugggacaccgucaccggcgucgacauggcccucuga

SEQ ID NO: 120174 - RNA, 1401 nt, Artificial Sequence; identical to SEQ ID NO: 120096
  derived and/or modified sequence opt2 from neuraminidase__InfluenzaB__ABL77149

SEQ ID NO: 120175 - RNA, 1401 nt, Artificial Sequence
  derived and/or modified sequence opt2 from neuraminidase__InfluenzaB__ABL77160
augcuccccuccaccauccagacccucacccucuuccucaccuccggcggcguccuccucucccucuacgucuccgccucccucuccuaccuccucuacuccgacauccuccucaaguucucccagaccaagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgaccgcggcuccggcggcaucaagggcggcuucguccaccagcgcauggaguccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccaccaucuacugccucaugggcuccggccagcuccucugggacaccgucaccggcgucgacauggcccucuga

SEQ ID NO: 120176 - RNA, 1401 nt, Artificial Sequence; identical to SEQ ID NO: 120128
  derived and/or modified sequence opt2 from neuraminidase__InfluenzaB__ABL77171

SEQ ID NO: 120177 - RNA, 1401 nt, Artificial Sequence
  derived and/or modified sequence opt2 from neuraminidase__InfluenzaB__ABL77182
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucgucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccaucaccggcgucgacauggcccucuga

SEQ ID NO: 120178 - RNA, 1401 nt, Artificial Sequence; identical to SEQ ID NO: 120103
  derived and/or modified sequence opt2 from neuraminidase__InfluenzaB__ABL77193

SEQ ID NO: 120179 - RNA, 1401 nt, Artificial Sequence
  derived and/or modified sequence opt2 from neuraminidase__InfluenzaB__ABL77204
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccucauccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacuccgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120180 - RNA, 1401 nt, Artificial Sequence
  derived and/or modified sequence opt2 from neuraminidase__InfluenzaB__ABL77215
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120181 - RNA, 1401 nt, Artificial Sequence; identical to SEQ ID NO: 120139
  derived and/or modified sequence opt2 from neuraminidase__InfluenzaB__ABL77226

SEQ ID NO: 120182 - RNA, 1401 nt, Artificial Sequence
  derived and/or modified sequence opt2 from neuraminidase__InfluenzaB__ABL77237
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120183 - RNA, 1401 nt, Artificial Sequence
  derived and/or modified sequence opt2 from neuraminidase__InfluenzaB__ABL77248
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaugucccucgacugcgccaacgccuccaacguccaggccgccaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgagaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccccuccggcgucauggucuccaugaaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120184 - RNA, 1401 nt, Artificial Sequence
  derived and/or modified sequence opt2 from neuraminidase__InfluenzaB__ABL77259
augcuccccuccaccauccagacccucacccucuuccucaccuccggcggcguccuccucucccucuacgucuccgccucccucuccuaccuccucuacuccgacauccuccucaaguucucccccaccgagaucaccgcccccaaggucccccucgacugcgccaacgccuccaacguccaggccgucaaccgcuccgccaccaagggcaugacccuccuccucuccgagcccgaguggaccuacccccgccucuccugccagggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccccuccggcgucauggucuccaugaaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120185 - RNA, 1401 nt, Artificial Sequence
  derived and/or modified sequence opt2 from neuraminidase__InfluenzaB__ABL77270
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcaugacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgaggcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120186 - RNA, 1401 nt, Artificial Sequence
  derived and/or modified sequence opt2 from neuraminidase__InfluenzaB__ABL77281
augcuccccuccaccauccagacccucacccucuuccucaccuccggcggcguccuccucucccucuacgucuccgucucccucuccuaccuccucuacuccgacauccuccuccgcuucucccccaccgagaucaccgcccccaccaugccccucgacugcgccaacgccuccaacguccaggccgucaaccgcuccgccaccaagggcaugacccuccgccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccgagaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgaggcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120187 - RNA, 1401 nt, Artificial Sequence
  derived and/or modified sequence opt2 from neuraminidase__InfluenzaB__ABL77292
augcuccccuccaccauccagacccucacccucuuccucaccuccggcggcguccuccucucccucuacgucuccgccucccucuccuaccuccucuacuccggcguccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagaugcgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccucggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120188 - RNA, 1398 nt, Artificial Sequence
  derived and/or modified sequence opt2 from neuraminidase__InfluenzaB__ABL77303
augcuccccuccaccauccagacccucacccucuuccucaccuccggcggcguccuccucucccucuacgucuccgcccuccucuccuaccuccucuacuccgacauccuccucaaguucucccccaagaucaucgcccccaccaucucccucgacugcgccaacgccuccaacguccaggccgucaaccacuccgccaccaaggagaugaccuuccuccuccccgagcccgaguggaccuacccccgccucuccugccagggcuccaucuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcgucaagggcggcuucguccaccagcgcaucgccuccaagaucggccgcugguacucccgcaccauguccaagaccgagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120189 - RNA, 1398 nt, Artificial Sequence
  derived and/or modified sequence opt2 from neuraminidase__InfluenzaB__ABL77314
augcuccccuccaccauccagacccucacccucuuccucaccuccggcggcguccuccucucccucuacgucuccgcccuccucuccuaccuccucuacuccgacguccuccucaaguucucccccaagaucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccacggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagauccgcgacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120190 - RNA, 1401 nt, Artificial Sequence
  derived and/or modified sequence opt2 from neuraminidase__InfluenzaB__ABL77325
augcuccccuccaccauccagacccucacccucuuccucaccuccggcggcguccuccucucccucuacgucuccgcccuccucuccuacucccucuacuccgacauccuccucaaguucucccccaccaagaccaucgcccccaccaugucccucgacugcgccaacgccuccaacguccaggccgucaaccacuccgccaccaagggcaugacccuccuccuccccgagcccgaguggaccuacccccgccucuccugccagggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucucccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgaccacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgccucggcauggagcucuacgucaaguacgacggcgaccccuggaccgacuccgacgcccucgcccccuccggcgucauggucuccgccgaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120191 - RNA, 1401 nt, Artificial Sequence
  derived and/or modified sequence opt2 from neuraminidase__InfluenzaB__ABL77336
augcuccccuccaccauccagacccucacccucuuccucaccuccggcggcguccuccucucccucuacgucuccgccucccucuccuaccuccucuacuccgacauccuccucaaguucucccccaccgagaucaccgccccccccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgccaucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgaccgcaugggcauggagcucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccaccaucuacugccucaugggcuccggccagcuccucugggacaccgucaccggcgucgacauggcccucuga

SEQ ID NO: 120192 - RNA, 1401 nt, Artificial Sequence
  derived and/or modified sequence opt2 from neuraminidase__InfluenzaB__ABL77347
augcuccccuccaccauccagacccucacccucuuccucaccuccggcggcguccuccucucccucuacgucuccgccucccucuccuaccuccucuacuccgacauccuccucaaguucucccccaccaagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120193 - RNA, 1398 nt, Artificial Sequence
  derived and/or modified sequence opt2 from neuraminidase__InfluenzaB__ABL77380
augcuccccuccaccauccagacccucacccucuuccucaccuccggcggcguccuccucucccucuacgucuccgcccuccucuccuaccuccucuacuccgacauccuccucaaguucucccccaagaucaucgcccccaccaccucccucgacugcgccaacgccuccaacguccaggccgucaaccacuccgccaccaaggagaugaaguuccucccccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcgucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagcgcaccuggcacuccgccgccaccgccaucuacugccucaugggcuccggccagcuccucugggacaccgucaccggcgucaacauggcccucuga

SEQ ID NO: 120194 - RNA, 1401 nt, Artificial Sequence
  derived and/or modified sequence opt2 from neuraminidase__InfluenzaB__ABL77391
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120195 - RNA, 1401 nt, Artificial Sequence
  derived and/or modified sequence opt2 from neuraminidase__InfluenzaB__ABL84344
augcuccccuccaccauccagacccucacccucuuccucaccuccggcggcguccuccucucccucuacgucuccgccucccucuccuaccuccucuacuccgacauccuccucaaguucuccuccaccgagaucaccgcccccaccaugccccucaacugcgccaacgccuccaacguccaggccgucaaccacuccgccaccaagggcgucacccucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcgucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120196 - RNA, 1401 nt, Artificial Sequence
  derived and/or modified sequence opt2 from neuraminidase__InfluenzaB__ABN50397
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucaacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggaccucuga

SEQ ID NO: 120197 - RNA, 1401 nt, Artificial Sequence
  derived and/or modified sequence opt2 from neuraminidase__InfluenzaB__ABN50408
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucaacugcgccaacgccuccaacguccaggccgucaaccgcuccgccaccaagggcgucacccucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120198 - RNA, 1401 nt, Artificial Sequence
  derived and/or modified sequence opt2 from neuraminidase__InfluenzaB__ABN50419
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccucugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120199 - RNA, 1401 nt, Artificial Sequence
  derived and/or modified sequence opt2 from neuraminidase__InfluenzaB__ABN50430
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120200 - RNA, 1401 nt, Artificial Sequence; identical to SEQ ID NO: 120182
  derived and/or modified sequence opt2 from neuraminidase__InfluenzaB__ABN50463

SEQ ID NO: 120201 - RNA, 1401 nt, Artificial Sequence; identical to SEQ ID NO: 120096
  derived and/or modified sequence opt2 from neuraminidase__InfluenzaB__ABN50474

SEQ ID NO: 120202 - RNA, 1401 nt, Artificial Sequence
  derived and/or modified sequence opt2 from neuraminidase__InfluenzaB__ABN50485
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguucaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120203 - RNA, 1401 nt, Artificial Sequence
  derived and/or modified sequence opt2 from neuraminidase__InfluenzaB__ABN50496
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagcgcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120204 - RNA, 1401 nt, Artificial Sequence
  derived and/or modified sequence opt2 from neuraminidase__InfluenzaB__ABN50507
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucaacugcgccaacgccuccaacguccaggccgucaaccgcuccgccaccaagggcgucacccucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugccgccacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120205 - RNA, 1401 nt, Artificial Sequence; identical to SEQ ID NO: 120103
  derived and/or modified sequence opt2 from neuraminidase__InfluenzaB__ABN50518

SEQ ID NO: 120206 - RNA, 1401 nt, Artificial Sequence; identical to SEQ ID NO: 120103
  derived and/or modified sequence opt2 from neuraminidase__InfluenzaB__ABN50529

SEQ ID NO: 120207 - RNA, 1401 nt, Artificial Sequence; identical to SEQ ID NO: 120096
  derived and/or modified sequence opt2 from neuraminidase__InfluenzaB__ABN50540

SEQ ID NO: 120208 - RNA, 1401 nt, Artificial Sequence; identical to SEQ ID NO: 120128
  derived and/or modified sequence opt2 from neuraminidase__InfluenzaB__ABN50551

SEQ ID NO: 120209 - RNA, 1401 nt, Artificial Sequence
  derived and/or modified sequence opt2 from neuraminidase__InfluenzaB__ABN50562
augcuccccuccaccauccagacccucacccucuuccucaccuccggcggcgcccuccucucccucuacgucuccgcccuccucuccuaccuccucuacuccgacauccuccucaaguucucccccaccaaggucaucgcccccaccaugucccucgacuacaccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcaacggcggcaucaagggcggcuucguccaccagcgcauggccucccgcaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120210 - RNA, 1401 nt, Artificial Sequence; identical to SEQ ID NO: 120199
  derived and/or modified sequence opt2 from neuraminidase__InfluenzaB__ABN50573

SEQ ID NO: 120211 - RNA, 1401 nt, Artificial Sequence
  derived and/or modified sequence opt2 from neuraminidase__InfluenzaB__ABN50584
augcuccccuccaccauccagacccucacccucuuccucaccuccggcggcguccuccucucccucuacgucuccgccucccucuccuaccuccucuacuccgacauccuccucaaguucucccccaccgagaucaccgccuccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgaguccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120212 - RNA, 1401 nt, Artificial Sequence; identical to SEQ ID NO: 120096
  derived and/or modified sequence opt2 from neuraminidase__InfluenzaB__ABN50595

SEQ ID NO: 120213 - RNA, 1398 nt, Artificial Sequence
  derived and/or modified sequence opt2 from neuraminidase__InfluenzaB__ABN50606
augcuccccuccaccauccagacccucacccucuuccucaccuccggcggcguccuccucucccucuacgucuccgccucccucuccuaccuccucuacuccgacauccuccuccgcuucuccuccaagaucaccgcccccaccaugacccucgacugcgccaacgccuccaacguccaggccgucaaccgcuccgccaccaaggagaugaccuuccuccuccccgagcccgaguggaccuacccccgccucuccugccagggcuccaccuuccagaaggcccuccucaucuccccccaccgcuucggcgaggcccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccgacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccccuccggcgucauggucuccaugaaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120214 - RNA, 1398 nt, Artificial Sequence
  derived and/or modified sequence opt2 from neuraminidase__InfluenzaB__ABN50628
augcuccccuccaccauccagacccucacccucuuccucaccuccggcggcguccuccucucccucuacgucuccgcccuccucuccuaccuccucuacuccgacauccuccucaaguucucccccaagaucaucgcccccaccaugucccucgacugcgccaacgccuccaacguccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcgucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120215 - RNA, 1398 nt, Artificial Sequence
  derived and/or modified sequence opt2 from neuraminidase__InfluenzaB__ABN50639
augcuccccuccaccauccagacccucacccucuuccucaccuccggcggcguccuccucucccucuacgucuccgcccuccucuccuaccuccucuacuccgacauccuccucaaguucucccccaagaucaucgcccccaccaugucccucgacugcgccaacgccuccaacguccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucgucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcgucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120216 - RNA, 1398 nt, Artificial Sequence
  derived and/or modified sequence opt2 from neuraminidase__InfluenzaB__ABN50650
augcuccccuccaccauccagacccucacccucuuccucaccuccggcggcguccuccucucccucuacgucuccgcccuccucuccuaccuccucuacuccgacguccuccucaaguucucccccaagaucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccacggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120217 - RNA, 1398 nt, Artificial Sequence
  derived and/or modified sequence opt2 from neuraminidase__InfluenzaB__ABN50661
augcuccccuccaccauccagacccucacccucuuccucaccuccggcggcguccuccucucccucuacgucuccgcccuccucuccuaccuccucuacuccgacguccuccucaaguucucccccaagaugaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccacggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120218 - RNA, 1401 nt, Artificial Sequence
  derived and/or modified sequence opt2 from neuraminidase__InfluenzaB__ABN50683
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccucggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccucuccggcgucaugguccccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120219 - RNA, 1401 nt, Artificial Sequence
  derived and/or modified sequence opt2 from neuraminidase__InfluenzaB__ABN50694
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120220 - RNA, 1398 nt, Artificial Sequence
  derived and/or modified sequence opt2 from neuraminidase__InfluenzaB__ABN50705
augcuccccuccaccauccagacccucacccucuuccucacccucggcggcguccuccucucccucuacgucuccgcccuccucuccuaccuccucuacuccgacguccuccucaaguucucccccaagaugaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccacggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120221 - RNA, 1401 nt, Artificial Sequence
  derived and/or modified sequence opt2 from neuraminidase__InfluenzaB__ABN50716
augcuccccuccaccauccagacccucacccucuuccucaccuccggcggcguccuccucucccucuacgucuccgccucccucuccuaccuccucuacuccggcauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120222 - RNA, 1401 nt, Artificial Sequence
  derived and/or modified sequence opt2 from neuraminidase__InfluenzaB__ABN50727
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120223 - RNA, 1401 nt, Artificial Sequence; identical to SEQ ID NO: 120165
  derived and/or modified sequence opt2 from neuraminidase__InfluenzaB__ABN50738

SEQ ID NO: 120224 - RNA, 1401 nt, Artificial Sequence
  derived and/or modified sequence opt2 from neuraminidase__InfluenzaB__ABN50749
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120225 - RNA, 1398 nt, Artificial Sequence
  derived and/or modified sequence opt2 from neuraminidase__InfluenzaB__ABN51188
augcuccccuccaccauccagacccucacccucuuccucaccuccggcggcguccuccucucccucuacgucuccgcccuccucuccuaccuccucuacuccgacauccuccucaaguucucccccaagaucaucgcccccaccaugcuccucgacugcgccaacgccuccaacguccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcgucaagggcggcuucguccaccagcgcauggccuccaagaucggccgcugguacucccgcaccauguccaagaccgagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120226 - RNA, 1398 nt, Artificial Sequence; identical to SEQ ID NO: 120214
  derived and/or modified sequence opt2 from neuraminidase__InfluenzaB__ABN51199

SEQ ID NO: 120227 - RNA, 1401 nt, Artificial Sequence
  derived and/or modified sequence opt2 from neuraminidase__InfluenzaB__ABN58665
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120228 - RNA, 1401 nt, Artificial Sequence; identical to SEQ ID NO: 120115
  derived and/or modified sequence opt2 from neuraminidase__InfluenzaB__ABN59449

SEQ ID NO: 120229 - RNA, 1398 nt, Artificial Sequence; identical to SEQ ID NO: 120193
  derived and/or modified sequence opt2 from neuraminidase__InfluenzaB__ABR15999

SEQ ID NO: 120230 - RNA, 1401 nt, Artificial Sequence; identical to SEQ ID NO: 120222
  derived and/or modified sequence opt2 from neuraminidase__InfluenzaB__ABR16010

SEQ ID NO: 120231 - RNA, 1401 nt, Artificial Sequence
  derived and/or modified sequence opt2 from neuraminidase__InfluenzaB__ABR16021
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcaagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120232 - RNA, 1401 nt, Artificial Sequence; identical to SEQ ID NO: 120147
  derived and/or modified sequence opt2 from neuraminidase__InfluenzaB__ACA64903

SEQ ID NO: 120233 - RNA, 1401 nt, Artificial Sequence
  derived and/or modified sequence opt2 from neuraminidase__InfluenzaB__ACA64914
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120234 - RNA, 1401 nt, Artificial Sequence; identical to SEQ ID NO: 120147
  derived and/or modified sequence opt2 from neuraminidase__InfluenzaB__ACA64936

SEQ ID NO: 120235 - RNA, 1401 nt, Artificial Sequence
  derived and/or modified sequence opt2 from neuraminidase__InfluenzaB__ACA64969
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120236 - RNA, 1401 nt, Artificial Sequence
  derived and/or modified sequence opt2 from neuraminidase__InfluenzaB__ACA64980
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccuccaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120237 - RNA, 1401 nt, Artificial Sequence
  derived and/or modified sequence opt2 from neuraminidase__InfluenzaB__ACA64991
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucggcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120238 - RNA, 1401 nt, Artificial Sequence; identical to SEQ ID NO: 120147
  derived and/or modified sequence opt2 from neuraminidase__InfluenzaB__ACA65013

SEQ ID NO: 120239 - RNA, 1401 nt, Artificial Sequence; identical to SEQ ID NO: 120147
  derived and/or modified sequence opt2 from neuraminidase__InfluenzaB__ACA65024

SEQ ID NO: 120240 - RNA, 1401 nt, Artificial Sequence
  derived and/or modified sequence opt2 from neuraminidase__InfluenzaB__ACA65035
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccuccaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120241 - RNA, 1401 nt, Artificial Sequence; identical to SEQ ID NO: 120147
  derived and/or modified sequence opt2 from neuraminidase__InfluenzaB__ACA65046

SEQ ID NO: 120242 - RNA, 1401 nt, Artificial Sequence
  derived and/or modified sequence opt2 from neuraminidase__InfluenzaB__ACA65057
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgaggccgacaccgccgagauccgccucaugugcaccgacaccuaccucgacaccccccgccccgacgacggcuccaucaccggccccugcgaguucaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120243 - RNA, 1401 nt, Artificial Sequence; identical to SEQ ID NO: 120147
  derived and/or modified sequence opt2 from neuraminidase__InfluenzaB__ACA65068

SEQ ID NO: 120244 - RNA, 1401 nt, Artificial Sequence; identical to SEQ ID NO: 120147
  derived and/or modified sequence opt2 from neuraminidase__InfluenzaB__ACA65079

SEQ ID NO: 120245 - RNA, 1401 nt, Artificial Sequence; identical to SEQ ID NO: 120147
  derived and/or modified sequence opt2 from neuraminidase__InfluenzaB__ACA65090

SEQ ID NO: 120246 - RNA, 1401 nt, Artificial Sequence; identical to SEQ ID NO: 120147
  derived and/or modified sequence opt2 from neuraminidase__InfluenzaB__ACA65101

SEQ ID NO: 120247 - RNA, 1401 nt, Artificial Sequence
  derived and/or modified sequence opt2 from neuraminidase__InfluenzaB__ACA96567
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgagugggccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcaucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120248 - RNA, 1401 nt, Artificial Sequence; identical to SEQ ID NO: 120147
  derived and/or modified sequence opt2 from neuraminidase__InfluenzaB__ACA96578

SEQ ID NO: 120249 - RNA, 1401 nt, Artificial Sequence; identical to SEQ ID NO: 120235
  derived and/or modified sequence opt2 from neuraminidase__InfluenzaB__ACA96589

SEQ ID NO: 120250 - RNA, 1401 nt, Artificial Sequence; identical to SEQ ID NO: 120147
  derived and/or modified sequence opt2 from neuraminidase__InfluenzaB__ACA96600

SEQ ID NO: 120251 - RNA, 1401 nt, Artificial Sequence
  derived and/or modified sequence opt2 from neuraminidase__InfluenzaB__ACA96611
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacuacgccaacgccuccaacguccacgccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccgccuccucugggacaccgucaccggcgucgacauggcccucuga

SEQ ID NO: 120252 - RNA, 1401 nt, Artificial Sequence
  derived and/or modified sequence opt2 from neuraminidase__InfluenzaB__ACA96622
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaucggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120253 - RNA, 1401 nt, Artificial Sequence; identical to SEQ ID NO: 120235
  derived and/or modified sequence opt2 from neuraminidase__InfluenzaB__ACA96633

SEQ ID NO: 120254 - RNA, 1401 nt, Artificial Sequence
  derived and/or modified sequence opt2 from neuraminidase__InfluenzaB__ACA96644
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccaucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucaugaucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120255 - RNA, 1401 nt, Artificial Sequence
  derived and/or modified sequence opt2 from neuraminidase__InfluenzaB__ACA96655
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120256 - RNA, 1401 nt, Artificial Sequence
  derived and/or modified sequence opt2 from neuraminidase__InfluenzaB__ACA96666
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacgacggcaaggagaccuggcacuccgccgccaccgccaucuacugccucaugggcuccggccagcuccucugggacaccgucaccggcgucgacauggcccucuga

SEQ ID NO: 120257 - RNA, 1401 nt, Artificial Sequence
  derived and/or modified sequence opt2 from neuraminidase__InfluenzaB__ACD56581
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120258 - RNA, 1401 nt, Artificial Sequence
  derived and/or modified sequence opt2 from neuraminidase__InfluenzaB__ACF33793
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaucccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120259 - RNA, 1401 nt, Artificial Sequence
  derived and/or modified sequence opt2 from neuraminidase__InfluenzaB__ACF33795
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagaagaugggcaugggccucuacgucaaguacgacggcgagcccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120260 - RNA, 1401 nt, Artificial Sequence
  derived and/or modified sequence opt2 from neuraminidase__InfluenzaB__ACF33797
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacacccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucaucggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120261 - RNA, 1401 nt, Artificial Sequence; identical to SEQ ID NO: 120240
  derived and/or modified sequence opt2 from neuraminidase__InfluenzaB__ACF41662

SEQ ID NO: 120262 - RNA, 1401 nt, Artificial Sequence
  derived and/or modified sequence opt2 from neuraminidase__InfluenzaB__ACF54140
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcaccaagggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120263 - RNA, 1401 nt, Artificial Sequence
  derived and/or modified sequence opt2 from neuraminidase__InfluenzaB__ACF54151
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcaaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120264 - RNA, 1401 nt, Artificial Sequence
  derived and/or modified sequence opt2 from neuraminidase__InfluenzaB__ACF54162
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacaacuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120265 - RNA, 1401 nt, Artificial Sequence
  derived and/or modified sequence opt2 from neuraminidase__InfluenzaB__ACF54184
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcaccaaggaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120266 - RNA, 1401 nt, Artificial Sequence
  derived and/or modified sequence opt2 from neuraminidase__InfluenzaB__ACF54206
augcuccccuccaccauccagacccucacccucuuccucaccuccggcggcguccuccucucccucuacgucuccgccucccucuccuaccuccucuacuccgacauccuccucaaguucuccaccaccgagaccaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120267 - RNA, 1401 nt, Artificial Sequence
  derived and/or modified sequence opt2 from neuraminidase__InfluenzaB__ACF54217
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120268 - RNA, 1401 nt, Artificial Sequence; identical to SEQ ID NO: 120159
  derived and/or modified sequence opt2 from neuraminidase__InfluenzaB__ACF54228

SEQ ID NO: 120269 - RNA, 1401 nt, Artificial Sequence; identical to SEQ ID NO: 120180
  derived and/or modified sequence opt2 from neuraminidase__InfluenzaB__ACF54239

SEQ ID NO: 120270 - RNA, 1401 nt, Artificial Sequence
  derived and/or modified sequence opt2 from neuraminidase__InfluenzaB__ACF54261
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucgucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120271 - RNA, 1401 nt, Artificial Sequence
  derived and/or modified sequence opt2 from neuraminidase__InfluenzaB__ACF54272
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120272 - RNA, 1401 nt, Artificial Sequence
  derived and/or modified sequence opt2 from neuraminidase__InfluenzaB__ACF54283
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucgucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120273 - RNA, 1401 nt, Artificial Sequence
  derived and/or modified sequence opt2 from neuraminidase__InfluenzaB__ACF54294
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaucccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120274 - RNA, 1401 nt, Artificial Sequence
  derived and/or modified sequence opt2 from neuraminidase__InfluenzaB__ACF54305
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucgagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120275 - RNA, 1401 nt, Artificial Sequence
  derived and/or modified sequence opt2 from neuraminidase__InfluenzaB__ACF54316
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucaucggcgucauggucuccauggaggagcccggcugguacuccuucggcuucgagaucaaggacaagaacugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120276 - RNA, 1404 nt, Artificial Sequence
  derived and/or modified sequence opt2 from neuraminidase__InfluenzaB__ACF54338
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacgacggcgaccccugggccgacuccgacgcccucgucuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120277 - RNA, 1401 nt, Artificial Sequence
  derived and/or modified sequence opt2 from neuraminidase__InfluenzaB__ACF54349
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucaacccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120278 - RNA, 1401 nt, Artificial Sequence
  derived and/or modified sequence opt2 from neuraminidase__InfluenzaB__ACF54371
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaccggcuccggccagcuccucugggacaccgucaccggcgucgacauggcccucuga

SEQ ID NO: 120279 - RNA, 1401 nt, Artificial Sequence
  derived and/or modified sequence opt2 from neuraminidase__InfluenzaB__ACI22549
augcuccccuccaccauccagacccucacccucuuccucaccuccggcggcguccuccucucccucuacgucuccgccucccucuccuaccuccucuacuccgacauccuccucaaguucucccccaccgagaucaccgcccgcaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgaggacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucaucggcgucauggucuccauggaggagcccggcugguacuccuucggcuucgagaucaaggacaagaacugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120280 - RNA, 1401 nt, Artificial Sequence
  derived and/or modified sequence opt2 from neuraminidase__InfluenzaB__ACI22551
augcuccccuccaccauccagacccucacccucuuccucaccuccggcggcguccuccucucccucuacgucuccgccucccucuccuaccuccucuacuccgacauccuccucaaguucucccccaccgagaucaccgcccucaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucaucggcgucauggucuccauggaggagcccggcugguacuccuucggcuucgagaucaaggacaagaacugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120281 - RNA, 1401 nt, Artificial Sequence; identical to SEQ ID NO: 120280
  derived and/or modified sequence opt2 from neuraminidase__InfluenzaB__ACI22555

SEQ ID NO: 120282 - RNA, 1401 nt, Artificial Sequence; identical to SEQ ID NO: 120147
  derived and/or modified sequence opt2 from neuraminidase__InfluenzaB__ACI22557

SEQ ID NO: 120283 - RNA, 1401 nt, Artificial Sequence
  derived and/or modified sequence opt2 from neuraminidase__InfluenzaB__ACI22559
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccucuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120284 - RNA, 1401 nt, Artificial Sequence
  derived and/or modified sequence opt2 from neuraminidase__InfluenzaB__ACI22561
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcggcacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120285 - RNA, 1401 nt, Artificial Sequence; identical to SEQ ID NO: 120147
  derived and/or modified sequence opt2 from neuraminidase__InfluenzaB__ACI22563

SEQ ID NO: 120286 - RNA, 1401 nt, Artificial Sequence
  derived and/or modified sequence opt2 from neuraminidase__InfluenzaB__ACI22565
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaucgagcgcaagggcaugggccucuacgucaaguacgacggcgaccccugggccgacuccgacgcccucgccuucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120287 - RNA, 1401 nt, Artificial Sequence; identical to SEQ ID NO: 120147
  derived and/or modified sequence opt2 from neuraminidase__InfluenzaB__ACI22567

SEQ ID NO: 120288 - RNA, 1401 nt, Artificial Sequence; identical to SEQ ID NO: 120147
  derived and/or modified sequence opt2 from neuraminidase__InfluenzaB__ACI22569

SEQ ID NO: 120289 - RNA, 1401 nt, Artificial Sequence
  derived and/or modified sequence opt2 from neuraminidase__InfluenzaB__ACJ53908
augcuccacuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccuccguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120290 - RNA, 1401 nt, Artificial Sequence; identical to SEQ ID NO: 120165
  derived and/or modified sequence opt2 from neuraminidase__InfluenzaB__ACN32560

SEQ ID NO: 120291 - RNA, 1401 nt, Artificial Sequence; identical to SEQ ID NO: 120235
  derived and/or modified sequence opt2 from neuraminidase__InfluenzaB__ACN32582

SEQ ID NO: 120292 - RNA, 1401 nt, Artificial Sequence; identical to SEQ ID NO: 120147
  derived and/or modified sequence opt2 from neuraminidase__InfluenzaB__ACN32593

SEQ ID NO: 120293 - RNA, 1401 nt, Artificial Sequence
  derived and/or modified sequence opt2 from neuraminidase__InfluenzaB__ACN32604
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguucaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120294 - RNA, 1401 nt, Artificial Sequence; identical to SEQ ID NO: 120147
  derived and/or modified sequence opt2 from neuraminidase__InfluenzaB__ACN32615

SEQ ID NO: 120295 - RNA, 1401 nt, Artificial Sequence
  derived and/or modified sequence opt2 from neuraminidase__InfluenzaB__ACN32775
augcuccccuccaccauccagacccucacccucuuccucaccuccggcggcguccuccucucccucuacgucuccgccucccucuccuaccuccucuacuccgacauccuccucaaguucucccccaccgagaucaacgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaaguccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120296 - RNA, 1401 nt, Artificial Sequence; identical to SEQ ID NO: 120147
  derived and/or modified sequence opt2 from neuraminidase__InfluenzaB__ACN32786

SEQ ID NO: 120297 - RNA, 1401 nt, Artificial Sequence
  derived and/or modified sequence opt2 from neuraminidase__InfluenzaB__ACO05928
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucaugguccccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120298 - RNA, 1401 nt, Artificial Sequence; identical to SEQ ID NO: 120159
  derived and/or modified sequence opt2 from neuraminidase__InfluenzaB__ACO05950

SEQ ID NO: 120299 - RNA, 1401 nt, Artificial Sequence
  derived and/or modified sequence opt2 from neuraminidase__InfluenzaB__ACO05961
augcuccccuccaccauccagacccucacccucuuccucaccuccggcggcguccuccucucccucuacgucuccgccucccucuccuaccuccccuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120300 - RNA, 1401 nt, Artificial Sequence
  derived and/or modified sequence opt2 from neuraminidase__InfluenzaB__ACO05972
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120301 - RNA, 1401 nt, Artificial Sequence; identical to SEQ ID NO: 120300
  derived and/or modified sequence opt2 from neuraminidase__InfluenzaB__ACO05983

SEQ ID NO: 120302 - RNA, 1401 nt, Artificial Sequence; identical to SEQ ID NO: 120300
  derived and/or modified sequence opt2 from neuraminidase__InfluenzaB__ACO05994

SEQ ID NO: 120303 - RNA, 1401 nt, Artificial Sequence
  derived and/or modified sequence opt2 from neuraminidase__InfluenzaB__ACO06005
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120304 - RNA, 1401 nt, Artificial Sequence
  derived and/or modified sequence opt2 from neuraminidase__InfluenzaB__ACO06027
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacaugacccucuga

SEQ ID NO: 120305 - RNA, 1401 nt, Artificial Sequence
  derived and/or modified sequence opt2 from neuraminidase__InfluenzaB__ACO06066
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgucgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacaugacccucuga

SEQ ID NO: 120306 - RNA, 1401 nt, Artificial Sequence
  derived and/or modified sequence opt2 from neuraminidase__InfluenzaB__ACO94665
augcuccccuccaccauccagacccucacccucuuccucaccuccggcggcguccuccucucccucuacgucuccgccucccucuccuaccuccucuacuccgacauccuccucaaguucucccccaccgagaucaccgccuccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120307 - RNA, 1401 nt, Artificial Sequence; identical to SEQ ID NO: 120147
  derived and/or modified sequence opt2 from neuraminidase__InfluenzaB__ACQ45607

SEQ ID NO: 120308 - RNA, 1401 nt, Artificial Sequence
  derived and/or modified sequence opt2 from neuraminidase__InfluenzaB__ACQ45610
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccgucccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaaguacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120309 - RNA, 1401 nt, Artificial Sequence; identical to SEQ ID NO: 120147
  derived and/or modified sequence opt2 from neuraminidase__InfluenzaB__ACQ45613

SEQ ID NO: 120310 - RNA, 1401 nt, Artificial Sequence; identical to SEQ ID NO: 120303
  derived and/or modified sequence opt2 from neuraminidase__InfluenzaB__ACR15626

SEQ ID NO: 120311 - RNA, 1401 nt, Artificial Sequence; identical to SEQ ID NO: 120303
  derived and/or modified sequence opt2 from neuraminidase__InfluenzaB__ACR15637

SEQ ID NO: 120312 - RNA, 1401 nt, Artificial Sequence; identical to SEQ ID NO: 120274
  derived and/or modified sequence opt2 from neuraminidase__InfluenzaB__ACR15648

SEQ ID NO: 120313 - RNA, 1401 nt, Artificial Sequence; identical to SEQ ID NO: 120303
  derived and/or modified sequence opt2 from neuraminidase__InfluenzaB__ACR15659

SEQ ID NO: 120314 - RNA, 1401 nt, Artificial Sequence; identical to SEQ ID NO: 120303
  derived and/or modified sequence opt2 from neuraminidase__InfluenzaB__ACR15670

SEQ ID NO: 120315 - RNA, 1401 nt, Artificial Sequence; identical to SEQ ID NO: 120128
  derived and/or modified sequence opt2 from neuraminidase__InfluenzaB__ACR15681

SEQ ID NO: 120316 - RNA, 1401 nt, Artificial Sequence
  derived and/or modified sequence opt2 from neuraminidase__InfluenzaB__ACR15692
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucggcugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacaacgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120317 - RNA, 1401 nt, Artificial Sequence; identical to SEQ ID NO: 120304
  derived and/or modified sequence opt2 from neuraminidase__InfluenzaB__ACR15703

SEQ ID NO: 120318 - RNA, 1401 nt, Artificial Sequence; identical to SEQ ID NO: 120304
  derived and/or modified sequence opt2 from neuraminidase__InfluenzaB__ACR15714

SEQ ID NO: 120319 - RNA, 1401 nt, Artificial Sequence; identical to SEQ ID NO: 120219
  derived and/or modified sequence opt2 from neuraminidase__InfluenzaB__ACR15725

SEQ ID NO: 120320 - RNA, 1401 nt, Artificial Sequence; identical to SEQ ID NO: 120180
  derived and/or modified sequence opt2 from neuraminidase__InfluenzaB__ACR15736

SEQ ID NO: 120321 - RNA, 1401 nt, Artificial Sequence; identical to SEQ ID NO: 120303
  derived and/or modified sequence opt2 from neuraminidase__InfluenzaB__ACR39340

SEQ ID NO: 120322 - RNA, 1401 nt, Artificial Sequence
  derived and/or modified sequence opt2 from neuraminidase__InfluenzaB__ADL28399
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaucaucgagugcgccugccgcgacuccuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120323 - RNA, 1401 nt, Artificial Sequence; identical to SEQ ID NO: 120300
  derived and/or modified sequence opt2 from neuraminidase__InfluenzaB__ADN32822

SEQ ID NO: 120324 - RNA, 1401 nt, Artificial Sequence
  derived and/or modified sequence opt2 from neuraminidase__InfluenzaB__ADR02756
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaucccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120325 - RNA, 1401 nt, Artificial Sequence
  derived and/or modified sequence opt2 from neuraminidase__InfluenzaB__AEA51353
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcggcgccuucaccgacaccuaccacuccuacgccaagaacauccucuccccccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120326 - RNA, 1401 nt, Artificial Sequence
  derived and/or modified sequence opt2 from neuraminidase__InfluenzaB__AEA51355
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacaccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaccuacggcgaggccuaccccggcaccuaccacuccuacgccaucaagaacccccgcacccaggaguccgcccccaacugcuucggcggccacuccuuccccaucaucacccacgccccccccuccggcgucugggagccccgcuuccucaagauccgcgagggccgcaucaucaacgagaucuuccccaccggccgcgucaagccccccgaggagugcaccugcggcuucgccuccaacaacaccaucgagugcgccugccgcgacaacaacugcaccgccaagcgccccuucgucaaguuccacgucgaguccgaccccgccgagauccgcgccaugugcaccgacaccuaccucgacuccccccgccccgacgacggcuccaucaccggccccugcgacuccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccaacuccggcgucauggucuccaugaacgagcccggcuccuccuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120327 - RNA, 1401 nt, Artificial Sequence
  derived and/or modified sequence opt2 from neuraminidase__InfluenzaB__AEA51357
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguucggcgaggccuacaccgacaccuaccacuccuacgccaagaacauccucggcacccaggaguccgccugcaacugcaucggcggcgacugcaaccucaugaucaccgacggccccgccuccggcaucuccgagucccgcuuccucaagaucggcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120328 - RNA, 1401 nt, Artificial Sequence
  derived and/or modified sequence opt2 from neuraminidase__InfluenzaB__AEA51359
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120329 - RNA, 1401 nt, Artificial Sequence
  derived and/or modified sequence opt2 from neuraminidase__InfluenzaB__AEA51365
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120330 - RNA, 1401 nt, Artificial Sequence; identical to SEQ ID NO: 120329
  derived and/or modified sequence opt2 from neuraminidase__InfluenzaB__AEA51367

SEQ ID NO: 120331 - RNA, 1401 nt, Artificial Sequence; identical to SEQ ID NO: 120329
  derived and/or modified sequence opt2 from neuraminidase__InfluenzaB__AEA51371

SEQ ID NO: 120332 - RNA, 1401 nt, Artificial Sequence
  derived and/or modified sequence opt2 from neuraminidase__InfluenzaB__AEA51373
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 120333 - RNA, 1401 nt, Artificial Sequence
  derived and/or modified sequence opt2 from neuraminidase__InfluenzaB__AEA51377
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120334 - RNA, 1401 nt, Artificial Sequence; identical to SEQ ID NO: 120333
  derived and/or modified sequence opt2 from neuraminidase__InfluenzaB__AEA51379

SEQ ID NO: 120335 - RNA, 1401 nt, Artificial Sequence
  derived and/or modified sequence opt2 from neuraminidase__InfluenzaB__AEA51381
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccgucaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120336 - RNA, 1401 nt, Artificial Sequence; identical to SEQ ID NO: 120333
  derived and/or modified sequence opt2 from neuraminidase__InfluenzaB__AEA51383

SEQ ID NO: 120337 - RNA, 1401 nt, Artificial Sequence
  derived and/or modified sequence opt2 from neuraminidase__InfluenzaB__AEG20998
augcuccccuccaccauccagacccucacccucuuccucaccuccggcggcguccuccucucccucuacgucuccgccucccucuccuaccuccucuacuccgacauccuccucaaguucucccgcaccgagaucaccgcccccauccuccgccucgccugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcggcgccuucaccgacaccuaccacuccuacgccaagaacauccucuccccccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120338 - RNA, 1401 nt, Artificial Sequence
  derived and/or modified sequence opt2 from neuraminidase__InfluenzaB__AEG20999
augcuccccuccaccauccagacccucacccucuuccucaccuccggcggcguccuccucucccucuccgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcggcgccuucaccgacaccuaccacuccuacgccaagaacauccucuccccccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120339 - RNA, 1401 nt, Artificial Sequence
  derived and/or modified sequence opt2 from neuraminidase__InfluenzaB__AEG21000
augcuccccuccaccauccagacccucacccucuuccucaccuccggcggcguccuccucucccucuacgucuccgccucccucuccuaccuccucuacuccgacauccuccucaaguucucccgcaccgagaucaccgccgccauccucauccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcggcgccuucaccgacaccuaccacuccuacgccaagaacauccucuccccccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120340 - RNA, 1401 nt, Artificial Sequence
  derived and/or modified sequence opt2 from neuraminidase__InfluenzaB__AEG21002
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcguccgccacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120341 - RNA, 1401 nt, Artificial Sequence
  derived and/or modified sequence opt2 from neuraminidase__InfluenzaB__AEG21003
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120342 - RNA, 1401 nt, Artificial Sequence
  derived and/or modified sequence opt2 from neuraminidase__InfluenzaB__AEG21004
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcggcggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120343 - RNA, 1401 nt, Artificial Sequence
  derived and/or modified sequence opt2 from neuraminidase__InfluenzaB__AEG21005
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcggcggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 120344 - RNA, 1401 nt, Artificial Sequence; identical to SEQ ID NO: 120329
  derived and/or modified sequence opt2 from neuraminidase__InfluenzaB__AEG21006

SEQ ID NO: 120345 - RNA, 1401 nt, Artificial Sequence; identical to SEQ ID NO: 120333
  derived and/or modified sequence opt2 from neuraminidase__InfluenzaB__AEG21007

SEQ ID NO: 120346 - RNA, 1401 nt, Artificial Sequence
  derived and/or modified sequence opt2 from neuraminidase__InfluenzaB__AEG21008
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120347 - RNA, 1401 nt, Artificial Sequence; identical to SEQ ID NO: 120333
  derived and/or modified sequence opt2 from neuraminidase__InfluenzaB__AEG21009

SEQ ID NO: 120348 - RNA, 1401 nt, Artificial Sequence; identical to SEQ ID NO: 120333
  derived and/or modified sequence opt2 from neuraminidase__InfluenzaB__AEG21010

SEQ ID NO: 120349 - RNA, 1401 nt, Artificial Sequence; identical to SEQ ID NO: 120333
  derived and/or modified sequence opt2 from neuraminidase__InfluenzaB__AEG21011

SEQ ID NO: 120350 - RNA, 1401 nt, Artificial Sequence; identical to SEQ ID NO: 120333
  derived and/or modified sequence opt2 from neuraminidase__InfluenzaB__AEG21012

SEQ ID NO: 120351 - RNA, 1401 nt, Artificial Sequence
  derived and/or modified sequence opt2 from neuraminidase__InfluenzaB__AEG21013
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120352 - RNA, 1401 nt, Artificial Sequence
  derived and/or modified sequence opt2 from neuraminidase__InfluenzaB__AEN68957
augcuccccuccaccauccagacccucacccucuuccucaccuccggcggcguccuccucucccucuacgucuccgccucccucuccuaccuccucuacuccgacauccuccucaaguucucccgcaccgagauccccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagaugcgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaaguacaccgaggagugcaccugcggcuucgccuccaacaagaccaucggcugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcucaugugggacaccgucaccggcgucaacaugacccucuga

SEQ ID NO: 120353 - RNA, 1401 nt, Artificial Sequence
  derived and/or modified sequence opt2 from neuraminidase__InfluenzaB__AEO80071
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120354 - RNA, 1401 nt, Artificial Sequence
  derived and/or modified sequence opt2 from neuraminidase__InfluenzaB__AEO80082
augcuccccuccaccauccagacccucacccucuuccucaccuccggcggcguccuccucucccucuacgucuccgccucccucuccuaccuccucuacuccgacauccuccucaaguucucccagaccggcaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaaguacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120355 - RNA, 1401 nt, Artificial Sequence; identical to SEQ ID NO: 120194
  derived and/or modified sequence opt2 from neuraminidase__InfluenzaB__AEO80090

SEQ ID NO: 120356 - RNA, 1401 nt, Artificial Sequence; identical to SEQ ID NO: 120139
  derived and/or modified sequence opt2 from neuraminidase__InfluenzaB__AEO80101

SEQ ID NO: 120357 - RNA, 1401 nt, Artificial Sequence; identical to SEQ ID NO: 120235
  derived and/or modified sequence opt2 from neuraminidase__InfluenzaB__AEO80149

SEQ ID NO: 120358 - RNA, 1401 nt, Artificial Sequence; identical to SEQ ID NO: 120147
  derived and/or modified sequence opt2 from neuraminidase__InfluenzaB__AEO80158

SEQ ID NO: 120359 - RNA, 1401 nt, Artificial Sequence; identical to SEQ ID NO: 120147
  derived and/or modified sequence opt2 from neuraminidase__InfluenzaB__AEO80167

SEQ ID NO: 120360 - RNA, 1401 nt, Artificial Sequence; identical to SEQ ID NO: 120235
  derived and/or modified sequence opt2 from neuraminidase__InfluenzaB__AEO80176

SEQ ID NO: 120361 - RNA, 1401 nt, Artificial Sequence
  derived and/or modified sequence opt2 from neuraminidase__InfluenzaB__AEO80187
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucggcugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120362 - RNA, 1401 nt, Artificial Sequence
  derived and/or modified sequence opt2 from neuraminidase__InfluenzaB__AEO80198
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120363 - RNA, 1401 nt, Artificial Sequence; identical to SEQ ID NO: 120303
  derived and/or modified sequence opt2 from neuraminidase__InfluenzaB__AEO80209

SEQ ID NO: 120364 - RNA, 1401 nt, Artificial Sequence
  derived and/or modified sequence opt2 from neuraminidase__InfluenzaB__AEO80220
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggccucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaccuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120365 - RNA, 1401 nt, Artificial Sequence; identical to SEQ ID NO: 120300
  derived and/or modified sequence opt2 from neuraminidase__InfluenzaB__AEO80231

SEQ ID NO: 120366 - RNA, 1401 nt, Artificial Sequence; identical to SEQ ID NO: 120303
  derived and/or modified sequence opt2 from neuraminidase__InfluenzaB__AEO80242

SEQ ID NO: 120367 - RNA, 1401 nt, Artificial Sequence; identical to SEQ ID NO: 120147
  derived and/or modified sequence opt2 from neuraminidase__InfluenzaB__AEP20182

SEQ ID NO: 120368 - RNA, 1401 nt, Artificial Sequence
  derived and/or modified sequence opt2 from neuraminidase__InfluenzaB__AEP20193
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccgucaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120369 - RNA, 1401 nt, Artificial Sequence
  derived and/or modified sequence opt2 from neuraminidase__InfluenzaB__AEP20204
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaucaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120370 - RNA, 1401 nt, Artificial Sequence; identical to SEQ ID NO: 120199
  derived and/or modified sequence opt2 from neuraminidase__InfluenzaB__AEP20215

SEQ ID NO: 120371 - RNA, 1401 nt, Artificial Sequence
  derived and/or modified sequence opt2 from neuraminidase__InfluenzaB__AEP20237
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacgccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120372 - RNA, 1401 nt, Artificial Sequence; identical to SEQ ID NO: 120199
  derived and/or modified sequence opt2 from neuraminidase__InfluenzaB__AEP20248

SEQ ID NO: 120373 - RNA, 1401 nt, Artificial Sequence
  derived and/or modified sequence opt2 from neuraminidase__InfluenzaB__AEP20259
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaucaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120374 - RNA, 1401 nt, Artificial Sequence
  derived and/or modified sequence opt2 from neuraminidase__InfluenzaB__AEP20281
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccaccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120375 - RNA, 1401 nt, Artificial Sequence; identical to SEQ ID NO: 120147
  derived and/or modified sequence opt2 from neuraminidase__InfluenzaB__AEP20292

SEQ ID NO: 120376 - RNA, 1401 nt, Artificial Sequence; identical to SEQ ID NO: 120139
  derived and/or modified sequence opt2 from neuraminidase__InfluenzaB__AEP20303

SEQ ID NO: 120377 - RNA, 1401 nt, Artificial Sequence
  derived and/or modified sequence opt2 from neuraminidase__InfluenzaB__AEP20314
augcuccccuccaccauccagacccucacccucuuccucaccuccggcggcguccuccucucccucuacgucuccgccucccucuccuaccuccucuacuccgacauccuccucaaguucucccagaccggcaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugaucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120378 - RNA, 1401 nt, Artificial Sequence
  derived and/or modified sequence opt2 from neuraminidase__InfluenzaB__AEP20336
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucacccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccuccaucuacugccucaugggcuccggccagcuccucugggacaccgucaccggcgucgacauggcccucuga

SEQ ID NO: 120379 - RNA, 1401 nt, Artificial Sequence
  derived and/or modified sequence opt2 from neuraminidase__InfluenzaB__AEP20347
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugguccccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120380 - RNA, 1401 nt, Artificial Sequence; identical to SEQ ID NO: 120379
  derived and/or modified sequence opt2 from neuraminidase__InfluenzaB__AEP20358

SEQ ID NO: 120381 - RNA, 1401 nt, Artificial Sequence; identical to SEQ ID NO: 120379
  derived and/or modified sequence opt2 from neuraminidase__InfluenzaB__AEP20369

SEQ ID NO: 120382 - RNA, 1401 nt, Artificial Sequence; identical to SEQ ID NO: 120379
  derived and/or modified sequence opt2 from neuraminidase__InfluenzaB__AEP20380

SEQ ID NO: 120383 - RNA, 1401 nt, Artificial Sequence
  derived and/or modified sequence opt2 from neuraminidase__InfluenzaB__AEP20391
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaaccgccuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaaggucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120384 - RNA, 1401 nt, Artificial Sequence
  derived and/or modified sequence opt2 from neuraminidase__InfluenzaB__AEP20413
augcuccccuccaccauccagacccucacccucuuccucaccuccggcggcguccuccucucccucuacgucuccgcccuccucuccuaccuccucuacuccgacauccuccucaaguucucccccaccgagaucaucgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacaacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120385 - RNA, 1401 nt, Artificial Sequence; identical to SEQ ID NO: 120384
  derived and/or modified sequence opt2 from neuraminidase__InfluenzaB__AEP20435

SEQ ID NO: 120386 - RNA, 1401 nt, Artificial Sequence; identical to SEQ ID NO: 120379
  derived and/or modified sequence opt2 from neuraminidase__InfluenzaB__AEQ39031

SEQ ID NO: 120387 - RNA, 1401 nt, Artificial Sequence
  derived and/or modified sequence opt2 from neuraminidase__InfluenzaB__AEQ39275
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120388 - RNA, 1401 nt, Artificial Sequence; identical to SEQ ID NO: 120387
  derived and/or modified sequence opt2 from neuraminidase__InfluenzaB__AEQ39286

SEQ ID NO: 120389 - RNA, 1401 nt, Artificial Sequence; identical to SEQ ID NO: 120387
  derived and/or modified sequence opt2 from neuraminidase__InfluenzaB__AEQ39297

SEQ ID NO: 120390 - RNA, 1401 nt, Artificial Sequence; identical to SEQ ID NO: 120387
  derived and/or modified sequence opt2 from neuraminidase__InfluenzaB__AEQ39308

SEQ ID NO: 120391 - RNA, 1401 nt, Artificial Sequence; identical to SEQ ID NO: 120387
  derived and/or modified sequence opt2 from neuraminidase__InfluenzaB__AEQ39319

SEQ ID NO: 120392 - RNA, 1401 nt, Artificial Sequence
  derived and/or modified sequence opt2 from neuraminidase__InfluenzaB__AEQ39330
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacaucgcccucuga

SEQ ID NO: 120393 - RNA, 1401 nt, Artificial Sequence; identical to SEQ ID NO: 120387
  derived and/or modified sequence opt2 from neuraminidase__InfluenzaB__AEQ39341

SEQ ID NO: 120394 - RNA, 1401 nt, Artificial Sequence; identical to SEQ ID NO: 120387
  derived and/or modified sequence opt2 from neuraminidase__InfluenzaB__AEQ39352

SEQ ID NO: 120395 - RNA, 1401 nt, Artificial Sequence; identical to SEQ ID NO: 120387
  derived and/or modified sequence opt2 from neuraminidase__InfluenzaB__AEQ39363

SEQ ID NO: 120396 - RNA, 1401 nt, Artificial Sequence; identical to SEQ ID NO: 120353
  derived and/or modified sequence opt2 from neuraminidase__InfluenzaB__AEQ39374

SEQ ID NO: 120397 - RNA, 1401 nt, Artificial Sequence
  derived and/or modified sequence opt2 from neuraminidase__InfluenzaB__AEQ39385
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcaugaccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120398 - RNA, 1401 nt, Artificial Sequence
  derived and/or modified sequence opt2 from neuraminidase__InfluenzaB__AEQ39444
augcuccccuccaccauccagacccucacccucuuccucaccuccggcggcguccuccucucccucuacgucuccgccucccucuccuaccuccucuacuccgacauccuccucaaguucucccagaccgagaucaucgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120399 - RNA, 1401 nt, Artificial Sequence; identical to SEQ ID NO: 120300
  derived and/or modified sequence opt2 from neuraminidase__InfluenzaB__AEQ39455

SEQ ID NO: 120400 - RNA, 1401 nt, Artificial Sequence
  derived and/or modified sequence opt2 from neuraminidase__InfluenzaB__AEQ39466
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaaggucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120401 - RNA, 1401 nt, Artificial Sequence; identical to SEQ ID NO: 120387
  derived and/or modified sequence opt2 from neuraminidase__InfluenzaB__AEQ39477

SEQ ID NO: 120402 - RNA, 1401 nt, Artificial Sequence
  derived and/or modified sequence opt2 from neuraminidase__InfluenzaB__AEQ39488
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggagucccgcaucggccgcugguacucccgcaccauguccaagaccgagcgcaugggcaugggccucuacgucaaguacgacggcgaccccuggaccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120403 - RNA, 1401 nt, Artificial Sequence; identical to SEQ ID NO: 120353
  derived and/or modified sequence opt2 from neuraminidase__InfluenzaB__AEQ39499

SEQ ID NO: 120404 - RNA, 1401 nt, Artificial Sequence; identical to SEQ ID NO: 120199
  derived and/or modified sequence opt2 from neuraminidase__InfluenzaB__AEQ39510

SEQ ID NO: 120405 - RNA, 1401 nt, Artificial Sequence
  derived and/or modified sequence opt2 from neuraminidase__InfluenzaB__AEQ49685
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggaccucuga

SEQ ID NO: 120406 - RNA, 1401 nt, Artificial Sequence
  derived and/or modified sequence opt2 from neuraminidase__InfluenzaB__AEQ49686
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120407 - RNA, 1401 nt, Artificial Sequence
  derived and/or modified sequence opt2 from neuraminidase__InfluenzaB__AEQ49687
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120408 - RNA, 1401 nt, Artificial Sequence
  derived and/or modified sequence opt2 from neuraminidase__InfluenzaB__AEQ49688
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucggcugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120409 - RNA, 1401 nt, Artificial Sequence
  derived and/or modified sequence opt2 from neuraminidase__InfluenzaB__AEQ49691
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120410 - RNA, 1401 nt, Artificial Sequence
  derived and/or modified sequence opt2 from neuraminidase__InfluenzaB__AEQ49692
augcuccccuccaccauccagacccucacccucuuccucaccuccggcggcguccuccucucccucuacgucuccgccucccucuccuaccuccucuacuccgacauccuccucaaguucucccccaccgagaccaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120411 - RNA, 1401 nt, Artificial Sequence
  derived and/or modified sequence opt2 from neuraminidase__InfluenzaB__AEQ49693
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaaccgcaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120412 - RNA, 1401 nt, Artificial Sequence
  derived and/or modified sequence opt2 from neuraminidase__InfluenzaB__AEQ49695
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120413 - RNA, 1401 nt, Artificial Sequence
  derived and/or modified sequence opt2 from neuraminidase__InfluenzaB__AEQ49697
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120414 - RNA, 1401 nt, Artificial Sequence; identical to SEQ ID NO: 120413
  derived and/or modified sequence opt2 from neuraminidase__InfluenzaB__AEQ49698

SEQ ID NO: 120415 - RNA, 1401 nt, Artificial Sequence; identical to SEQ ID NO: 120413
  derived and/or modified sequence opt2 from neuraminidase__InfluenzaB__AEQ49699

SEQ ID NO: 120416 - RNA, 1401 nt, Artificial Sequence; identical to SEQ ID NO: 120413
  derived and/or modified sequence opt2 from neuraminidase__InfluenzaB__AEQ49700

SEQ ID NO: 120417 - RNA, 1401 nt, Artificial Sequence; identical to SEQ ID NO: 120410
  derived and/or modified sequence opt2 from neuraminidase__InfluenzaB__AEQ49701

SEQ ID NO: 120418 - RNA, 1401 nt, Artificial Sequence; identical to SEQ ID NO: 120413
  derived and/or modified sequence opt2 from neuraminidase__InfluenzaB__AEQ49702

SEQ ID NO: 120419 - RNA, 1401 nt, Artificial Sequence; identical to SEQ ID NO: 120410
  derived and/or modified sequence opt2 from neuraminidase__InfluenzaB__AEQ49703

SEQ ID NO: 120420 - RNA, 1401 nt, Artificial Sequence; identical to SEQ ID NO: 120413
  derived and/or modified sequence opt2 from neuraminidase__InfluenzaB__AEQ49705

SEQ ID NO: 120421 - RNA, 1401 nt, Artificial Sequence
  derived and/or modified sequence opt2 from neuraminidase__InfluenzaB__AEQ49706
augcuccccuccaccauccagaugcucacccucuuccucacccucggcggcguccuccucucccucuacgucuccgccucccucuccuaccuccucuaccucgacauccuccucaaguucccccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuucaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120422 - RNA, 1401 nt, Artificial Sequence; identical to SEQ ID NO: 120413
  derived and/or modified sequence opt2 from neuraminidase__InfluenzaB__AEQ49707

SEQ ID NO: 120423 - RNA, 1401 nt, Artificial Sequence; identical to SEQ ID NO: 120413
  derived and/or modified sequence opt2 from neuraminidase__InfluenzaB__AEQ49708

SEQ ID NO: 120424 - RNA, 1401 nt, Artificial Sequence
  derived and/or modified sequence opt2 from neuraminidase__InfluenzaB__AEQ49709
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccaccuccucugggacaccgucaccggcgucgacauggcccucuga

SEQ ID NO: 120425 - RNA, 1401 nt, Artificial Sequence; identical to SEQ ID NO: 120387
  derived and/or modified sequence opt2 from neuraminidase__InfluenzaB__AEQ49710

SEQ ID NO: 120426 - RNA, 1401 nt, Artificial Sequence; identical to SEQ ID NO: 120384
  derived and/or modified sequence opt2 from neuraminidase__InfluenzaB__AER27042

SEQ ID NO: 120427 - RNA, 1401 nt, Artificial Sequence; identical to SEQ ID NO: 120412
  derived and/or modified sequence opt2 from neuraminidase__InfluenzaB__AER27053

SEQ ID NO: 120428 - RNA, 1401 nt, Artificial Sequence; identical to SEQ ID NO: 120384
  derived and/or modified sequence opt2 from neuraminidase__InfluenzaB__AER27064

SEQ ID NO: 120429 - RNA, 1401 nt, Artificial Sequence; identical to SEQ ID NO: 120387
  derived and/or modified sequence opt2 from neuraminidase__InfluenzaB__AET43128

SEQ ID NO: 120430 - RNA, 1401 nt, Artificial Sequence; identical to SEQ ID NO: 120387
  derived and/or modified sequence opt2 from neuraminidase__InfluenzaB__AET43139

SEQ ID NO: 120431 - RNA, 1401 nt, Artificial Sequence
  derived and/or modified sequence opt2 from neuraminidase__InfluenzaB__AET43150
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120432 - RNA, 1401 nt, Artificial Sequence; identical to SEQ ID NO: 120387
  derived and/or modified sequence opt2 from neuraminidase__InfluenzaB__AET43161

SEQ ID NO: 120433 - RNA, 1401 nt, Artificial Sequence; identical to SEQ ID NO: 120387
  derived and/or modified sequence opt2 from neuraminidase__InfluenzaB__AET43172

SEQ ID NO: 120434 - RNA, 1401 nt, Artificial Sequence; identical to SEQ ID NO: 120387
  derived and/or modified sequence opt2 from neuraminidase__InfluenzaB__AET43183

SEQ ID NO: 120435 - RNA, 1401 nt, Artificial Sequence; identical to SEQ ID NO: 120387
  derived and/or modified sequence opt2 from neuraminidase__InfluenzaB__AET43194

SEQ ID NO: 120436 - RNA, 1401 nt, Artificial Sequence; identical to SEQ ID NO: 120387
  derived and/or modified sequence opt2 from neuraminidase__InfluenzaB__AET43216

SEQ ID NO: 120437 - RNA, 1401 nt, Artificial Sequence; identical to SEQ ID NO: 120387
  derived and/or modified sequence opt2 from neuraminidase__InfluenzaB__AET43227

SEQ ID NO: 120438 - RNA, 1401 nt, Artificial Sequence
  derived and/or modified sequence opt2 from neuraminidase__InfluenzaB__AET50947
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucaugaucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120439 - RNA, 1401 nt, Artificial Sequence
  derived and/or modified sequence opt2 from neuraminidase__InfluenzaB__AET50958
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcucgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120440 - RNA, 1401 nt, Artificial Sequence; identical to SEQ ID NO: 120387
  derived and/or modified sequence opt2 from neuraminidase__InfluenzaB__AET50969

SEQ ID NO: 120441 - RNA, 1401 nt, Artificial Sequence; identical to SEQ ID NO: 120387
  derived and/or modified sequence opt2 from neuraminidase__InfluenzaB__AET50980

SEQ ID NO: 120442 - RNA, 1401 nt, Artificial Sequence; identical to SEQ ID NO: 120387
  derived and/or modified sequence opt2 from neuraminidase__InfluenzaB__AET74259

SEQ ID NO: 120443 - RNA, 1401 nt, Artificial Sequence; identical to SEQ ID NO: 120387
  derived and/or modified sequence opt2 from neuraminidase__InfluenzaB__AET74270

SEQ ID NO: 120444 - RNA, 1401 nt, Artificial Sequence; identical to SEQ ID NO: 120438
  derived and/or modified sequence opt2 from neuraminidase__InfluenzaB__AET74281

SEQ ID NO: 120445 - RNA, 1401 nt, Artificial Sequence; identical to SEQ ID NO: 120387
  derived and/or modified sequence opt2 from neuraminidase__InfluenzaB__AET74292

SEQ ID NO: 120446 - RNA, 1401 nt, Artificial Sequence; identical to SEQ ID NO: 120387
  derived and/or modified sequence opt2 from neuraminidase__InfluenzaB__AET74303

SEQ ID NO: 120447 - RNA, 1401 nt, Artificial Sequence; identical to SEQ ID NO: 120387
  derived and/or modified sequence opt2 from neuraminidase__InfluenzaB__AET74314

SEQ ID NO: 120448 - RNA, 1401 nt, Artificial Sequence; identical to SEQ ID NO: 120387
  derived and/or modified sequence opt2 from neuraminidase__InfluenzaB__AET74333

SEQ ID NO: 120449 - RNA, 1401 nt, Artificial Sequence
  derived and/or modified sequence opt2 from neuraminidase__InfluenzaB__AET74344
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgaggccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120450 - RNA, 1401 nt, Artificial Sequence; identical to SEQ ID NO: 120387
  derived and/or modified sequence opt2 from neuraminidase__InfluenzaB__AET74355

SEQ ID NO: 120451 - RNA, 1404 nt, Artificial Sequence
  derived and/or modified sequence opt2 from neuraminidase__InfluenzaB__AEY75594
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaccaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120452 - RNA, 1401 nt, Artificial Sequence
  derived and/or modified sequence opt2 from neuraminidase__InfluenzaB__AFA45223
augcuccccuccaccauccagacccucacccucuuccucaccuccggcggcguccuccucucccucuacgucuccgcccuccucuccuaccuccucuacuccgacauccuccccaaguucucccccaccgagaucaccgcccccaccaugucccucgacugcgccaacgccuccaacguccaggccgucaaccgcuccgccaccaagggcgucaccuuccuccucuccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120453 - RNA, 1401 nt, Artificial Sequence
  derived and/or modified sequence opt2 from neuraminidase__InfluenzaB__AFA45226
augcuccccuccaccauccagacccucacccucuuccucaccuccggcggcguccuccucucccucuacgucuccgccucccucuccuaccuccucuacuccgacauccuccucaaguucucccccaccgagaccaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagguccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaagggcaccuggcacuccgccgccaccgccaucuacugccucaugggcuccggccagcuccucugggacaccgucaccggcgucgacauggcccucuga

SEQ ID NO: 120454 - RNA, 1401 nt, Artificial Sequence
  derived and/or modified sequence opt2 from neuraminidase__InfluenzaB__AFA45229
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120455 - RNA, 1401 nt, Artificial Sequence; identical to SEQ ID NO: 120407
  derived and/or modified sequence opt2 from neuraminidase__InfluenzaB__AFA45235

SEQ ID NO: 120456 - RNA, 1401 nt, Artificial Sequence
  derived and/or modified sequence opt2 from neuraminidase__InfluenzaB__AFA45238
augcuccccuccaccauccagacccucacccucuuccucaccuccggcggcguccuccucucccucuacgucuccgccucccucuccuaccuccucuacuccgacauccuccucaaguucucccccaccaagaccaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120457 - RNA, 1401 nt, Artificial Sequence
  derived and/or modified sequence opt2 from neuraminidase__InfluenzaB__AFA45241
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaucuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120458 - RNA, 1401 nt, Artificial Sequence
  derived and/or modified sequence opt2 from neuraminidase__InfluenzaB__AFA45244
augcuccccuccaccauccagacccucacccucuuccucaccuccggcggcguccuccucucccucuacgucuccgccucccucuccuaccuccucuacuccgacauccuccucaaguucucccccaccgagaccaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120459 - RNA, 1401 nt, Artificial Sequence
  derived and/or modified sequence opt2 from neuraminidase__InfluenzaB__AFA45247
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120460 - RNA, 1401 nt, Artificial Sequence; identical to SEQ ID NO: 120410
  derived and/or modified sequence opt2 from neuraminidase__InfluenzaB__AFA45250

SEQ ID NO: 120461 - RNA, 1401 nt, Artificial Sequence
  derived and/or modified sequence opt2 from neuraminidase__InfluenzaB__AFA45253
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgucugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120462 - RNA, 1401 nt, Artificial Sequence
  derived and/or modified sequence opt2 from neuraminidase__InfluenzaB__AFB77645
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120463 - RNA, 1401 nt, Artificial Sequence
  derived and/or modified sequence opt2 from neuraminidase__InfluenzaB__AFB77647
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaucccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120464 - RNA, 1401 nt, Artificial Sequence
  derived and/or modified sequence opt2 from neuraminidase__InfluenzaB__AFB77649
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120465 - RNA, 1401 nt, Artificial Sequence
  derived and/or modified sequence opt2 from neuraminidase__InfluenzaB__AFB77651
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaccuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120466 - RNA, 1401 nt, Artificial Sequence
  derived and/or modified sequence opt2 from neuraminidase__InfluenzaB__AFE00364
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaaccgccuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120467 - RNA, 1401 nt, Artificial Sequence
  derived and/or modified sequence opt2 from neuraminidase__InfluenzaB__AFF18536
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugccgccacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcauccgcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120468 - RNA, 1401 nt, Artificial Sequence
  derived and/or modified sequence opt2 from neuraminidase__InfluenzaB__AFF18545
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120469 - RNA, 1401 nt, Artificial Sequence; identical to SEQ ID NO: 120329
  derived and/or modified sequence opt2 from neuraminidase__InfluenzaB__AFH34933

SEQ ID NO: 120470 - RNA, 1401 nt, Artificial Sequence; identical to SEQ ID NO: 120329
  derived and/or modified sequence opt2 from neuraminidase__InfluenzaB__AFH34939

SEQ ID NO: 120471 - RNA, 1401 nt, Artificial Sequence; identical to SEQ ID NO: 120267
  derived and/or modified sequence opt2 from neuraminidase__InfluenzaB__AFH57869

SEQ ID NO: 120472 - RNA, 1401 nt, Artificial Sequence
  derived and/or modified sequence opt2 from neuraminidase__InfluenzaB__AFH57891
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacuacgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120473 - RNA, 1401 nt, Artificial Sequence
  derived and/or modified sequence opt2 from neuraminidase__InfluenzaB__AFH57913
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120474 - RNA, 1401 nt, Artificial Sequence; identical to SEQ ID NO: 120329
  derived and/or modified sequence opt2 from neuraminidase__InfluenzaB__AFH57935

SEQ ID NO: 120475 - RNA, 1401 nt, Artificial Sequence; identical to SEQ ID NO: 120329
  derived and/or modified sequence opt2 from neuraminidase__InfluenzaB__AFH57946

SEQ ID NO: 120476 - RNA, 1401 nt, Artificial Sequence; identical to SEQ ID NO: 120329
  derived and/or modified sequence opt2 from neuraminidase__InfluenzaB__AFH57957

SEQ ID NO: 120477 - RNA, 1401 nt, Artificial Sequence; identical to SEQ ID NO: 120407
  derived and/or modified sequence opt2 from neuraminidase__InfluenzaB__AFH57968

SEQ ID NO: 120478 - RNA, 1401 nt, Artificial Sequence
  derived and/or modified sequence opt2 from neuraminidase__InfluenzaB__AFH57979
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaucuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120479 - RNA, 1401 nt, Artificial Sequence; identical to SEQ ID NO: 120096
  derived and/or modified sequence opt2 from neuraminidase__InfluenzaB__AFH58253

SEQ ID NO: 120480 - RNA, 1401 nt, Artificial Sequence; identical to SEQ ID NO: 120159
  derived and/or modified sequence opt2 from neuraminidase__InfluenzaB__AFH58264

SEQ ID NO: 120481 - RNA, 1401 nt, Artificial Sequence; identical to SEQ ID NO: 120300
  derived and/or modified sequence opt2 from neuraminidase__InfluenzaB__AFH58275

SEQ ID NO: 120482 - RNA, 1401 nt, Artificial Sequence; identical to SEQ ID NO: 120300
  derived and/or modified sequence opt2 from neuraminidase__InfluenzaB__AFH58286

SEQ ID NO: 120483 - RNA, 1401 nt, Artificial Sequence; identical to SEQ ID NO: 120473
  derived and/or modified sequence opt2 from neuraminidase__InfluenzaB__AFH58297

SEQ ID NO: 120484 - RNA, 1401 nt, Artificial Sequence
  derived and/or modified sequence opt2 from neuraminidase__InfluenzaB__AFH58308
augcuccccuccaccauccagacccucacccucuuccucaccuccggcggcguccuccucucccucuacgucuccgccucccucuccuaccuccucuacuccgacauccuccucaaguucucccgcaccgagaccaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120485 - RNA, 1401 nt, Artificial Sequence; identical to SEQ ID NO: 120484
  derived and/or modified sequence opt2 from neuraminidase__InfluenzaB__AFH58319

SEQ ID NO: 120486 - RNA, 1401 nt, Artificial Sequence
  derived and/or modified sequence opt2 from neuraminidase__InfluenzaB__AFH58341
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccguccgccucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120487 - RNA, 1401 nt, Artificial Sequence
  derived and/or modified sequence opt2 from neuraminidase__InfluenzaB__AFH58363
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120488 - RNA, 1401 nt, Artificial Sequence; identical to SEQ ID NO: 120487
  derived and/or modified sequence opt2 from neuraminidase__InfluenzaB__AFH58374

SEQ ID NO: 120489 - RNA, 1401 nt, Artificial Sequence; identical to SEQ ID NO: 120473
  derived and/or modified sequence opt2 from neuraminidase__InfluenzaB__AFH58385

SEQ ID NO: 120490 - RNA, 1401 nt, Artificial Sequence; identical to SEQ ID NO: 120473
  derived and/or modified sequence opt2 from neuraminidase__InfluenzaB__AFH58396

SEQ ID NO: 120491 - RNA, 1401 nt, Artificial Sequence; identical to SEQ ID NO: 120473
  derived and/or modified sequence opt2 from neuraminidase__InfluenzaB__AFH58407

SEQ ID NO: 120492 - RNA, 1401 nt, Artificial Sequence; identical to SEQ ID NO: 120473
  derived and/or modified sequence opt2 from neuraminidase__InfluenzaB__AFH58418

SEQ ID NO: 120493 - RNA, 1401 nt, Artificial Sequence
  derived and/or modified sequence opt2 from neuraminidase__InfluenzaB__AFH58429
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacgagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120494 - RNA, 1401 nt, Artificial Sequence
  derived and/or modified sequence opt2 from neuraminidase__InfluenzaB__AFH58440
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccaggagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120495 - RNA, 1401 nt, Artificial Sequence
  derived and/or modified sequence opt2 from neuraminidase__InfluenzaB__AFH58462
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacgagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacaugacccucuga

SEQ ID NO: 120496 - RNA, 1401 nt, Artificial Sequence; identical to SEQ ID NO: 120495
  derived and/or modified sequence opt2 from neuraminidase__InfluenzaB__AFH58473

SEQ ID NO: 120497 - RNA, 1401 nt, Artificial Sequence; identical to SEQ ID NO: 120329
  derived and/or modified sequence opt2 from neuraminidase__InfluenzaB__AFH58484

SEQ ID NO: 120498 - RNA, 1401 nt, Artificial Sequence; identical to SEQ ID NO: 120329
  derived and/or modified sequence opt2 from neuraminidase__InfluenzaB__AFH58495

SEQ ID NO: 120499 - RNA, 1401 nt, Artificial Sequence; identical to SEQ ID NO: 120329
  derived and/or modified sequence opt2 from neuraminidase__InfluenzaB__AFH58506

SEQ ID NO: 120500 - RNA, 1401 nt, Artificial Sequence
  derived and/or modified sequence opt2 from neuraminidase__InfluenzaB__AFH58517
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccgccuccucugggacaccgucaccggcgucgacauggcccucuga

SEQ ID NO: 120501 - RNA, 1401 nt, Artificial Sequence; identical to SEQ ID NO: 120407
  derived and/or modified sequence opt2 from neuraminidase__InfluenzaB__AFH58528

SEQ ID NO: 120502 - RNA, 1401 nt, Artificial Sequence
  derived and/or modified sequence opt2 from neuraminidase__InfluenzaB__AFH58539
augcuccccuccaccguccagacccucacccuccuccucaccuccggcggcguccuccucucccucuacgucuccgccucccucuccuaccuccucuacuccgacguccuccucaaguucuccuccaccaagaccaccgcccccaccaugucccucgagugcaccaacgccuccaacgcccagaccgucaaccacuccgccaccaaggagaugaccuuccccccccccgagcccgaguggaccuacccccgccucuccugccagggcuccaccuuccagaaggcccuccucaucuccccccaccgcuucggcgagaucaagggcaacuccgccccccucaucauccgcgagcccuucgucgccugcggccccaaggagugccgccacuucgcccucacccacuacgccgcccagcccggcggcuacuacaacggcacccgcaaggaccgcaacaagcuccgccaccucgucuccgucaagcucggcaagauccccaccgucgagaacuccaucuuccacauggccgccugguccggcuccgccugccacgacggccgcgaguggaccuacaucggcgucgacggccccgacaacgacgcccucgucaagaucaaguacggcgaggccuacaccgacaccuaccacuccuacgcccacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagauccuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucgccggccccugcgaguccaacggcgacaaguggcucggcggcaucaagggcggcuucguccaccagcgcauggccuccaagaucggccgcugguacucccgcaccauguccaagaccaaccgcaugggcauggagcucuacgucaaguacgacggcgaccccuggaccgacuccgacgcccucacccucuccggcgucauggucuccaucgaggagcccggcugguacuccuucggcuucgagaucaaggacaagaagugcgacguccccugcaucggcaucgagaugguccacgacggcggcaaggacaccuggcacuccgccgccaccgccaucuacugccucaugggcuccggccagcuccucugggacaccgccaccggcgucgacauggcccucuga

SEQ ID NO: 120503 - RNA, 1401 nt, Artificial Sequence
  derived and/or modified sequence opt2 from neuraminidase__InfluenzaB__AFH58550
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaaggagaugacccuccuccuccccgagcccgaguggaccuacccccgccucuccugccccggcuccaccuuccagaaggcccuccucaucuccccccaccgcuucggcgagacccgcggcaacuccgccccccucaccauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccgagcgcaugggcauggagcucuacgucaaguacgacggcgaccccuggaccgacuccgaggcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120504 - RNA, 1401 nt, Artificial Sequence; identical to SEQ ID NO: 120503
  derived and/or modified sequence opt2 from neuraminidase__InfluenzaB__AFH58561

SEQ ID NO: 120505 - RNA, 1401 nt, Artificial Sequence
  derived and/or modified sequence opt2 from neuraminidase__InfluenzaB__AFJ69969
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccuggaccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120506 - RNA, 1401 nt, Artificial Sequence; identical to SEQ ID NO: 120468
  derived and/or modified sequence opt2 from neuraminidase__InfluenzaB__AFJ69971

SEQ ID NO: 120507 - RNA, 1401 nt, Artificial Sequence
  derived and/or modified sequence opt2 from neuraminidase__InfluenzaB__AFJ69973
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgccugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120508 - RNA, 1401 nt, Artificial Sequence; identical to SEQ ID NO: 120329
  derived and/or modified sequence opt2 from neuraminidase__InfluenzaB__AFJ69975

SEQ ID NO: 120509 - RNA, 1401 nt, Artificial Sequence
  derived and/or modified sequence opt2 from neuraminidase__InfluenzaB__AFJ69979
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacaccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120510 - RNA, 1401 nt, Artificial Sequence; identical to SEQ ID NO: 120468
  derived and/or modified sequence opt2 from neuraminidase__InfluenzaB__AFJ69981

SEQ ID NO: 120511 - RNA, 1401 nt, Artificial Sequence
  derived and/or modified sequence opt2 from neuraminidase__InfluenzaB__AFJ69983
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagauccuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120512 - RNA, 1401 nt, Artificial Sequence
  derived and/or modified sequence opt2 from neuraminidase__InfluenzaB__AFJ69987
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaccaagggcggcuucguccaccagcgcaugaaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120513 - RNA, 1401 nt, Artificial Sequence
  derived and/or modified sequence opt2 from neuraminidase__InfluenzaB__AFJ76228
augcuccccuccaccauccagacccucacccucuuccucaccuccggcggcguccuccucucccucuacgucuccgccucccucuccuaccuccucuacuccggcauccuccucaaguucucccccaccgagaucaccgcccccaccaugccccucaacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120514 - RNA, 1401 nt, Artificial Sequence; identical to SEQ ID NO: 120180
  derived and/or modified sequence opt2 from neuraminidase__InfluenzaB__AFJ76261

SEQ ID NO: 120515 - RNA, 1401 nt, Artificial Sequence
  derived and/or modified sequence opt2 from neuraminidase__InfluenzaB__AFJ76283
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120516 - RNA, 1401 nt, Artificial Sequence
  derived and/or modified sequence opt2 from neuraminidase__InfluenzaB__AFJ76305
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagcgcgcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120517 - RNA, 1401 nt, Artificial Sequence
  derived and/or modified sequence opt2 from neuraminidase__InfluenzaB__AFJ76316
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120518 - RNA, 1401 nt, Artificial Sequence; identical to SEQ ID NO: 120180
  derived and/or modified sequence opt2 from neuraminidase__InfluenzaB__AFJ76338

SEQ ID NO: 120519 - RNA, 1401 nt, Artificial Sequence
  derived and/or modified sequence opt2 from neuraminidase__InfluenzaB__AFJ77331
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccuacaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120520 - RNA, 1401 nt, Artificial Sequence; identical to SEQ ID NO: 120255
  derived and/or modified sequence opt2 from neuraminidase__InfluenzaB__AFJ77351

SEQ ID NO: 120521 - RNA, 1401 nt, Artificial Sequence; identical to SEQ ID NO: 120147
  derived and/or modified sequence opt2 from neuraminidase__InfluenzaB__AFJ77362

SEQ ID NO: 120522 - RNA, 1401 nt, Artificial Sequence; identical to SEQ ID NO: 120300
  derived and/or modified sequence opt2 from neuraminidase__InfluenzaB__AFJ77384

SEQ ID NO: 120523 - RNA, 1401 nt, Artificial Sequence; identical to SEQ ID NO: 120222
  derived and/or modified sequence opt2 from neuraminidase__InfluenzaB__AFJ80132

SEQ ID NO: 120524 - RNA, 1401 nt, Artificial Sequence
  derived and/or modified sequence opt2 from neuraminidase__InfluenzaB__AFJ80143
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120525 - RNA, 1401 nt, Artificial Sequence
  derived and/or modified sequence opt2 from neuraminidase__InfluenzaB__AFJ80154
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggccauccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120526 - RNA, 1401 nt, Artificial Sequence
  derived and/or modified sequence opt2 from neuraminidase__InfluenzaB__AFJ80165
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaucccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacauccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120527 - RNA, 1401 nt, Artificial Sequence
  derived and/or modified sequence opt2 from neuraminidase__InfluenzaB__AFJ80176
augcuccccuccaccauccagacccucacccucuuccucaccuccggcggcguccuccucucccucuacgucuccgccucccucuccuaccuccucuacuccgacauccuccucaaguucucccccaccgagaucaccguccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120528 - RNA, 1401 nt, Artificial Sequence
  derived and/or modified sequence opt2 from neuraminidase__InfluenzaB__AFJ80187
augcuccccuccaccauccagacccucacccucuuccucaccuccggcggcguccuccucucccucuacgucuccgccucccucuccuaccuccucuacuccggcauccuccucaaguucucccccaccgagaucaccgcccccaccaugccccucaacugcgccaacgccuccaacuuccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120529 - RNA, 1401 nt, Artificial Sequence; identical to SEQ ID NO: 120524
  derived and/or modified sequence opt2 from neuraminidase__InfluenzaB__AFJ80198

SEQ ID NO: 120530 - RNA, 1401 nt, Artificial Sequence; identical to SEQ ID NO: 120152
  derived and/or modified sequence opt2 from neuraminidase__InfluenzaB__AFJ80220

SEQ ID NO: 120531 - RNA, 1401 nt, Artificial Sequence
  derived and/or modified sequence opt2 from neuraminidase__InfluenzaB__AFJ80231
augcuccccuccaccauccagacccucacccucuuccucaccuccggcggcguccuccucucccucuacgucuccgccucccucuccuaccuccucuacuccggcauccuccucaaguucucccucaccgagaucaccgcccccaccaugccccucaacugcgccaacgccuccaacguccaggccgucaaccgcuccgccaccaagggcgucacccucuuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucgagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120532 - RNA, 1401 nt, Artificial Sequence
  derived and/or modified sequence opt2 from neuraminidase__InfluenzaB__AFJ80242
augcuccccuccaccauccagacccucacccucuuccucaccuccggcggcguccuccucucccucuacgucuccgcccuccucuccuaccuccucuacuccgacauccuccucaaguucucccccaccaaggucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucucccgcugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcaacggcggcaucaagggcggcuucguccaccagcgcauggccucccgcaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120533 - RNA, 1401 nt, Artificial Sequence
  derived and/or modified sequence opt2 from neuraminidase__InfluenzaB__AFJ80660
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcaugaccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120534 - RNA, 1401 nt, Artificial Sequence; identical to SEQ ID NO: 120531
  derived and/or modified sequence opt2 from neuraminidase__InfluenzaB__AFJ80671

SEQ ID NO: 120535 - RNA, 1401 nt, Artificial Sequence; identical to SEQ ID NO: 120531
  derived and/or modified sequence opt2 from neuraminidase__InfluenzaB__AFJ80682

SEQ ID NO: 120536 - RNA, 1401 nt, Artificial Sequence
  derived and/or modified sequence opt2 from neuraminidase__InfluenzaB__AFJ80693
augcuccccuccaccauccagacccucacccucuuccucaccuccggcggcguccuccucucccucuacgucuccgccucccucuccuaccuccucuacuccggcauccuccucaaguucucccccaccgagaucaccgcccccaccaugccccucaacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgagucccacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccggcgcccucacccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 120537 - RNA, 1401 nt, Artificial Sequence
  derived and/or modified sequence opt2 from neuraminidase__InfluenzaB__AFJ80726
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgaccgcggcggcggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugguccccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120538 - RNA, 1401 nt, Artificial Sequence
  derived and/or modified sequence opt2 from neuraminidase__InfluenzaB__AFJ80737
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcauccgcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120539 - RNA, 1401 nt, Artificial Sequence; identical to SEQ ID NO: 120180
  derived and/or modified sequence opt2 from neuraminidase__InfluenzaB__AFJ80759

SEQ ID NO: 120540 - RNA, 1401 nt, Artificial Sequence
  derived and/or modified sequence opt2 from neuraminidase__InfluenzaB__AFJ80770
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucgacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcacccucuccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120541 - RNA, 1401 nt, Artificial Sequence; identical to SEQ ID NO: 120180
  derived and/or modified sequence opt2 from neuraminidase__InfluenzaB__AFJ80785

SEQ ID NO: 120542 - RNA, 1401 nt, Artificial Sequence; identical to SEQ ID NO: 120180
  derived and/or modified sequence opt2 from neuraminidase__InfluenzaB__AFJ80796

SEQ ID NO: 120543 - RNA, 1401 nt, Artificial Sequence
  derived and/or modified sequence opt2 from neuraminidase__InfluenzaB__AFJ80807
augcuccccuccaccauccagacccucacccucuuccucaccuccggcggcguccuccucucccucuacgucuccgucucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120544 - RNA, 1401 nt, Artificial Sequence; identical to SEQ ID NO: 120180
  derived and/or modified sequence opt2 from neuraminidase__InfluenzaB__AFJ80818

SEQ ID NO: 120545 - RNA, 1401 nt, Artificial Sequence; identical to SEQ ID NO: 120180
  derived and/or modified sequence opt2 from neuraminidase__InfluenzaB__AFJ80829

SEQ ID NO: 120546 - RNA, 1401 nt, Artificial Sequence; identical to SEQ ID NO: 120517
  derived and/or modified sequence opt2 from neuraminidase__InfluenzaB__AFJ80840

SEQ ID NO: 120547 - RNA, 1401 nt, Artificial Sequence; identical to SEQ ID NO: 120517
  derived and/or modified sequence opt2 from neuraminidase__InfluenzaB__AFJ80851

SEQ ID NO: 120548 - RNA, 1401 nt, Artificial Sequence
  derived and/or modified sequence opt2 from neuraminidase__InfluenzaB__AFJ80862
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccaugaaccgcuccgccaccaagggcgucacccuccuccuccccgagaccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120549 - RNA, 1401 nt, Artificial Sequence
  derived and/or modified sequence opt2 from neuraminidase__InfluenzaB__AFJ80873
augcuccccuccaccauccagacccucacccucuuccucaccuccggcggcguccuccucucccucuacgucuccgccucccucucccaccuccucuacuccggcauccuccucaaguuccccuccaccgagaucaccgcccccaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120550 - RNA, 1401 nt, Artificial Sequence
  derived and/or modified sequence opt2 from neuraminidase__InfluenzaB__AFJ80884
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccaagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120551 - RNA, 1401 nt, Artificial Sequence; identical to SEQ ID NO: 120516
  derived and/or modified sequence opt2 from neuraminidase__InfluenzaB__AFJ80895

SEQ ID NO: 120552 - RNA, 1401 nt, Artificial Sequence
  derived and/or modified sequence opt2 from neuraminidase__InfluenzaB__AFJ80917
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcaccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120553 - RNA, 1401 nt, Artificial Sequence
  derived and/or modified sequence opt2 from neuraminidase__InfluenzaB__AFJ80928
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcgagcccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120554 - RNA, 1401 nt, Artificial Sequence
  derived and/or modified sequence opt2 from neuraminidase__InfluenzaB__AFJ80939
augcuccccuccaccauccagacccucacccucuuccucaccuccggcggcguccuccucucccucuacgucuccgccucccucuccuaccuccucuacuccgacauccuccucaaguucccccccaccgaggucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120555 - RNA, 1401 nt, Artificial Sequence
  derived and/or modified sequence opt2 from neuraminidase__InfluenzaB__AFJ80950
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcaacggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120556 - RNA, 1401 nt, Artificial Sequence; identical to SEQ ID NO: 120517
  derived and/or modified sequence opt2 from neuraminidase__InfluenzaB__AFJ80961

SEQ ID NO: 120557 - RNA, 1401 nt, Artificial Sequence; identical to SEQ ID NO: 120300
  derived and/or modified sequence opt2 from neuraminidase__InfluenzaB__AFJ80972

SEQ ID NO: 120558 - RNA, 1401 nt, Artificial Sequence; identical to SEQ ID NO: 120300
  derived and/or modified sequence opt2 from neuraminidase__InfluenzaB__AFJ80983

SEQ ID NO: 120559 - RNA, 1401 nt, Artificial Sequence; identical to SEQ ID NO: 120255
  derived and/or modified sequence opt2 from neuraminidase__InfluenzaB__AFJ80994

SEQ ID NO: 120560 - RNA, 1401 nt, Artificial Sequence; identical to SEQ ID NO: 120300
  derived and/or modified sequence opt2 from neuraminidase__InfluenzaB__AFJ81005

SEQ ID NO: 120561 - RNA, 1401 nt, Artificial Sequence; identical to SEQ ID NO: 120300
  derived and/or modified sequence opt2 from neuraminidase__InfluenzaB__AFJ84364

SEQ ID NO: 120562 - RNA, 1401 nt, Artificial Sequence
  derived and/or modified sequence opt2 from neuraminidase__InfluenzaB__AFJ90399
augcuccccuccaccauccagacccucacccucuuccucaccuccggcggcguccuccucucccucuacgucuccgccucccucuccuaccuccucuacuccgacauccuccucaaguuccccuccaccgagaucaccgccccccccaugccccucgacugcgccaacgccuccaacguccaggccgucaaccgcuccgccaccaagggcgucacccuccuccuccccgagcccgaguggaccuacccccgccucuccugccccggcuccaccuuccagcgcgcccuccucaucuccccccaccgcuucggcgagaccaagggcaacuccgccccccucaucauccgcgagcccuucaucgccugcggcccccgcgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcaugaccuccaagaucggccgcugguacucccgcaccauguccaagaccgagcgcaugggcaugggccucuacgucaaguacgacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120563 - RNA, 1401 nt, Artificial Sequence
  derived and/or modified sequence opt2 from neuraminidase__InfluenzaB__AFJ90410
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccaagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaaccuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120564 - RNA, 1401 nt, Artificial Sequence
  derived and/or modified sequence opt2 from neuraminidase__InfluenzaB__AFJ90432
augcuccccuccaccauccagacccucacccucuuccucaccuccggcggcguccuccucucccucuacgucuccaccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120565 - RNA, 1401 nt, Artificial Sequence; identical to SEQ ID NO: 120484
  derived and/or modified sequence opt2 from neuraminidase__InfluenzaB__AFJ90443

SEQ ID NO: 120566 - RNA, 1401 nt, Artificial Sequence
  derived and/or modified sequence opt2 from neuraminidase__InfluenzaB__AFJ90454
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucgucccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcgaguacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120567 - RNA, 1401 nt, Artificial Sequence
  derived and/or modified sequence opt2 from neuraminidase__InfluenzaB__AFJ91042
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccucauccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucgccggccccugcgaguccgacggcgacaagggcuccggcggcaucaagggcggcuucguccaccagcgcaugaccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120568 - RNA, 1401 nt, Artificial Sequence
  derived and/or modified sequence opt2 from neuraminidase__InfluenzaB__AFJ91053
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaaggaggucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120569 - RNA, 1401 nt, Artificial Sequence
  derived and/or modified sequence opt2 from neuraminidase__InfluenzaB__AFJ91075
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacacccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120570 - RNA, 1401 nt, Artificial Sequence; identical to SEQ ID NO: 120329
  derived and/or modified sequence opt2 from neuraminidase__InfluenzaB__AFJ91086

SEQ ID NO: 120571 - RNA, 1401 nt, Artificial Sequence; identical to SEQ ID NO: 120329
  derived and/or modified sequence opt2 from neuraminidase__InfluenzaB__AFJ91097

SEQ ID NO: 120572 - RNA, 1401 nt, Artificial Sequence; identical to SEQ ID NO: 120329
  derived and/or modified sequence opt2 from neuraminidase__InfluenzaB__AFJ91108

SEQ ID NO: 120573 - RNA, 1401 nt, Artificial Sequence; identical to SEQ ID NO: 120329
  derived and/or modified sequence opt2 from neuraminidase__InfluenzaB__AFJ91119

SEQ ID NO: 120574 - RNA, 1401 nt, Artificial Sequence; identical to SEQ ID NO: 120180
  derived and/or modified sequence opt2 from neuraminidase__InfluenzaB__AFJ91707

SEQ ID NO: 120575 - RNA, 1401 nt, Artificial Sequence
  derived and/or modified sequence opt2 from neuraminidase__InfluenzaB__AFK09801
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgaccgcggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugguccccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120576 - RNA, 1401 nt, Artificial Sequence; identical to SEQ ID NO: 120304
  derived and/or modified sequence opt2 from neuraminidase__InfluenzaB__AFN54669

SEQ ID NO: 120577 - RNA, 1401 nt, Artificial Sequence; identical to SEQ ID NO: 120304
  derived and/or modified sequence opt2 from neuraminidase__InfluenzaB__AFN54680

SEQ ID NO: 120578 - RNA, 1401 nt, Artificial Sequence; identical to SEQ ID NO: 120329
  derived and/or modified sequence opt2 from neuraminidase__InfluenzaB__AFN54691

SEQ ID NO: 120579 - RNA, 1401 nt, Artificial Sequence; identical to SEQ ID NO: 120329
  derived and/or modified sequence opt2 from neuraminidase__InfluenzaB__AFN54702

SEQ ID NO: 120580 - RNA, 1401 nt, Artificial Sequence; identical to SEQ ID NO: 120329
  derived and/or modified sequence opt2 from neuraminidase__InfluenzaB__AFN54713

SEQ ID NO: 120581 - RNA, 1401 nt, Artificial Sequence; identical to SEQ ID NO: 120329
  derived and/or modified sequence opt2 from neuraminidase__InfluenzaB__AFN54724

SEQ ID NO: 120582 - RNA, 1401 nt, Artificial Sequence; identical to SEQ ID NO: 120329
  derived and/or modified sequence opt2 from neuraminidase__InfluenzaB__AFN54735

SEQ ID NO: 120583 - RNA, 1401 nt, Artificial Sequence; identical to SEQ ID NO: 120329
  derived and/or modified sequence opt2 from neuraminidase__InfluenzaB__AFN54746

SEQ ID NO: 120584 - RNA, 1401 nt, Artificial Sequence; identical to SEQ ID NO: 120329
  derived and/or modified sequence opt2 from neuraminidase__InfluenzaB__AFN54757

SEQ ID NO: 120585 - RNA, 1401 nt, Artificial Sequence; identical to SEQ ID NO: 120329
  derived and/or modified sequence opt2 from neuraminidase__InfluenzaB__AFN54768

SEQ ID NO: 120586 - RNA, 1401 nt, Artificial Sequence; identical to SEQ ID NO: 120329
  derived and/or modified sequence opt2 from neuraminidase__InfluenzaB__AFN54779

SEQ ID NO: 120587 - RNA, 1401 nt, Artificial Sequence; identical to SEQ ID NO: 120329
  derived and/or modified sequence opt2 from neuraminidase__InfluenzaB__AFN54790

SEQ ID NO: 120588 - RNA, 1401 nt, Artificial Sequence; identical to SEQ ID NO: 120329
  derived and/or modified sequence opt2 from neuraminidase__InfluenzaB__AFN54801

SEQ ID NO: 120589 - RNA, 1401 nt, Artificial Sequence; identical to SEQ ID NO: 120329
  derived and/or modified sequence opt2 from neuraminidase__InfluenzaB__AFN54812

SEQ ID NO: 120590 - RNA, 1401 nt, Artificial Sequence
  derived and/or modified sequence opt2 from neuraminidase__InfluenzaB__AFN54834
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaucuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120591 - RNA, 1401 nt, Artificial Sequence; identical to SEQ ID NO: 120329
  derived and/or modified sequence opt2 from neuraminidase__InfluenzaB__AFN54845

SEQ ID NO: 120592 - RNA, 1401 nt, Artificial Sequence
  derived and/or modified sequence opt2 from neuraminidase__InfluenzaB__AFN54856
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgccaccggcgucaacaugacccucuga

SEQ ID NO: 120593 - RNA, 1401 nt, Artificial Sequence; identical to SEQ ID NO: 120329
  derived and/or modified sequence opt2 from neuraminidase__InfluenzaB__AFN54867

SEQ ID NO: 120594 - RNA, 1401 nt, Artificial Sequence
  derived and/or modified sequence opt2 from neuraminidase__InfluenzaB__AFU34598
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccgcgaguccgccugcaacugcaucggcggcaacugcuaccucaugaucaccgacggcuccgccuccggcgucuccgagugccgcuuccucaagauccgcgucggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacgucgcccucuga

SEQ ID NO: 120595 - RNA, 1401 nt, Artificial Sequence
  derived and/or modified sequence opt2 from neuraminidase__InfluenzaB__AFU34609
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccacccgcggcgucaccuuccuccuccccgagcccgagugggccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120596 - RNA, 1401 nt, Artificial Sequence
  derived and/or modified sequence opt2 from neuraminidase__InfluenzaB__AFU34620
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccacccgcggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120597 - RNA, 1401 nt, Artificial Sequence
  derived and/or modified sequence opt2 from neuraminidase__InfluenzaB__AFU34631
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccacccgcggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcauccgcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120598 - RNA, 1401 nt, Artificial Sequence
  derived and/or modified sequence opt2 from neuraminidase__InfluenzaB__AFU34642
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgccaacgccuccaacguccaggccgucaaccgcuccgccaccaagggcaugaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacggcugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccuacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120599 - RNA, 1401 nt, Artificial Sequence
  derived and/or modified sequence opt2 from neuraminidase__InfluenzaB__AGB97261
augcuccccuccaccauccagacccucacccucuuccucaccuccggcggcguccuccucucccucuacgucuccgccucccucuccuaccuccucuacuccgacaugcuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 120600 - RNA, 1401 nt, Artificial Sequence
  derived and/or modified sequence opt2 from neuraminidase__InfluenzaB__AGB97267
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcaucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120601 - RNA, 1401 nt, Artificial Sequence; identical to SEQ ID NO: 120329
  derived and/or modified sequence opt2 from neuraminidase__InfluenzaB__AGR54784

SEQ ID NO: 120602 - RNA, 1401 nt, Artificial Sequence; identical to SEQ ID NO: 120194
  derived and/or modified sequence opt2 from neuraminidase__InfluenzaB__AGX15491

SEQ ID NO: 120603 - RNA, 1401 nt, Artificial Sequence
  derived and/or modified sequence opt2 from neuraminidase__InfluenzaB__AGX15533
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaaggucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120604 - RNA, 1401 nt, Artificial Sequence; identical to SEQ ID NO: 120147
  derived and/or modified sequence opt2 from neuraminidase__InfluenzaB__AGX15545

SEQ ID NO: 120605 - RNA, 1401 nt, Artificial Sequence; identical to SEQ ID NO: 120147
  derived and/or modified sequence opt2 from neuraminidase__InfluenzaB__AGX15556

SEQ ID NO: 120606 - RNA, 1401 nt, Artificial Sequence
  derived and/or modified sequence opt2 from neuraminidase__InfluenzaB__AGX15567
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120607 - RNA, 1401 nt, Artificial Sequence; identical to SEQ ID NO: 120147
  derived and/or modified sequence opt2 from neuraminidase__InfluenzaB__AGX15578

SEQ ID NO: 120608 - RNA, 1401 nt, Artificial Sequence; identical to SEQ ID NO: 120147
  derived and/or modified sequence opt2 from neuraminidase__InfluenzaB__AGX15589

SEQ ID NO: 120609 - RNA, 1401 nt, Artificial Sequence; identical to SEQ ID NO: 120353
  derived and/or modified sequence opt2 from neuraminidase__InfluenzaB__AGX15600

SEQ ID NO: 120610 - RNA, 1401 nt, Artificial Sequence; identical to SEQ ID NO: 120353
  derived and/or modified sequence opt2 from neuraminidase__InfluenzaB__AGX15611

SEQ ID NO: 120611 - RNA, 1401 nt, Artificial Sequence; identical to SEQ ID NO: 120473
  derived and/or modified sequence opt2 from neuraminidase__InfluenzaB__AGX15644

SEQ ID NO: 120612 - RNA, 1401 nt, Artificial Sequence; identical to SEQ ID NO: 120473
  derived and/or modified sequence opt2 from neuraminidase__InfluenzaB__AGX15655

SEQ ID NO: 120613 - RNA, 1401 nt, Artificial Sequence; identical to SEQ ID NO: 120473
  derived and/or modified sequence opt2 from neuraminidase__InfluenzaB__AGX15666

SEQ ID NO: 120614 - RNA, 1401 nt, Artificial Sequence; identical to SEQ ID NO: 120473
  derived and/or modified sequence opt2 from neuraminidase__InfluenzaB__AGX15679

SEQ ID NO: 120615 - RNA, 1401 nt, Artificial Sequence
  derived and/or modified sequence opt2 from neuraminidase__InfluenzaB__AGX15690
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120616 - RNA, 1401 nt, Artificial Sequence; identical to SEQ ID NO: 120473
  derived and/or modified sequence opt2 from neuraminidase__InfluenzaB__AGX15701

SEQ ID NO: 120617 - RNA, 1401 nt, Artificial Sequence
  derived and/or modified sequence opt2 from neuraminidase__InfluenzaB__AGX15712
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagcccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120618 - RNA, 1401 nt, Artificial Sequence; identical to SEQ ID NO: 120473
  derived and/or modified sequence opt2 from neuraminidase__InfluenzaB__AGX15723

SEQ ID NO: 120619 - RNA, 1401 nt, Artificial Sequence; identical to SEQ ID NO: 120473
  derived and/or modified sequence opt2 from neuraminidase__InfluenzaB__AGX15745

SEQ ID NO: 120620 - RNA, 1401 nt, Artificial Sequence; identical to SEQ ID NO: 120473
  derived and/or modified sequence opt2 from neuraminidase__InfluenzaB__AGX15757

SEQ ID NO: 120621 - RNA, 1401 nt, Artificial Sequence
  derived and/or modified sequence opt2 from neuraminidase__InfluenzaB__AGX15768
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucaugaucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120622 - RNA, 1401 nt, Artificial Sequence
  derived and/or modified sequence opt2 from neuraminidase__InfluenzaB__AGX15801
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgucaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120623 - RNA, 1401 nt, Artificial Sequence; identical to SEQ ID NO: 120473
  derived and/or modified sequence opt2 from neuraminidase__InfluenzaB__AGX15812

SEQ ID NO: 120624 - RNA, 1401 nt, Artificial Sequence; identical to SEQ ID NO: 120473
  derived and/or modified sequence opt2 from neuraminidase__InfluenzaB__AGX15823

SEQ ID NO: 120625 - RNA, 1401 nt, Artificial Sequence; identical to SEQ ID NO: 120407
  derived and/or modified sequence opt2 from neuraminidase__InfluenzaB__AGX15845

SEQ ID NO: 120626 - RNA, 1401 nt, Artificial Sequence; identical to SEQ ID NO: 120384
  derived and/or modified sequence opt2 from neuraminidase__InfluenzaB__AGX15856

SEQ ID NO: 120627 - RNA, 1401 nt, Artificial Sequence; identical to SEQ ID NO: 120407
  derived and/or modified sequence opt2 from neuraminidase__InfluenzaB__AGX15867

SEQ ID NO: 120628 - RNA, 1401 nt, Artificial Sequence; identical to SEQ ID NO: 120407
  derived and/or modified sequence opt2 from neuraminidase__InfluenzaB__AGX15889

SEQ ID NO: 120629 - RNA, 1401 nt, Artificial Sequence
  derived and/or modified sequence opt2 from neuraminidase__InfluenzaB__AGX15900
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacaccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgccgcggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120630 - RNA, 1401 nt, Artificial Sequence; identical to SEQ ID NO: 120407
  derived and/or modified sequence opt2 from neuraminidase__InfluenzaB__AGX15911

SEQ ID NO: 120631 - RNA, 1401 nt, Artificial Sequence
  derived and/or modified sequence opt2 from neuraminidase__InfluenzaB__AGX15933
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120632 - RNA, 1401 nt, Artificial Sequence; identical to SEQ ID NO: 120407
  derived and/or modified sequence opt2 from neuraminidase__InfluenzaB__AGX15944

SEQ ID NO: 120633 - RNA, 1401 nt, Artificial Sequence; identical to SEQ ID NO: 120468
  derived and/or modified sequence opt2 from neuraminidase__InfluenzaB__AGX15966

SEQ ID NO: 120634 - RNA, 1401 nt, Artificial Sequence
  derived and/or modified sequence opt2 from neuraminidase__InfluenzaB__AGX15988
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagguccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120635 - RNA, 1401 nt, Artificial Sequence; identical to SEQ ID NO: 120468
  derived and/or modified sequence opt2 from neuraminidase__InfluenzaB__AGX15999

SEQ ID NO: 120636 - RNA, 1401 nt, Artificial Sequence; identical to SEQ ID NO: 120468
  derived and/or modified sequence opt2 from neuraminidase__InfluenzaB__AGX16010

SEQ ID NO: 120637 - RNA, 1401 nt, Artificial Sequence; identical to SEQ ID NO: 120468
  derived and/or modified sequence opt2 from neuraminidase__InfluenzaB__AGX16021

SEQ ID NO: 120638 - RNA, 1401 nt, Artificial Sequence
  derived and/or modified sequence opt2 from neuraminidase__InfluenzaB__AGX16032
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120639 - RNA, 1401 nt, Artificial Sequence; identical to SEQ ID NO: 120255
  derived and/or modified sequence opt2 from neuraminidase__InfluenzaB__AGX16043

SEQ ID NO: 120640 - RNA, 1401 nt, Artificial Sequence; identical to SEQ ID NO: 120257
  derived and/or modified sequence opt2 from neuraminidase__InfluenzaB__AGX16054

SEQ ID NO: 120641 - RNA, 1401 nt, Artificial Sequence
  derived and/or modified sequence opt2 from neuraminidase__InfluenzaB__AGX16087
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacaacuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120642 - RNA, 1401 nt, Artificial Sequence
  derived and/or modified sequence opt2 from neuraminidase__InfluenzaB__AGX16109
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucgacgucgagaccgacaccgccgagauccgccucaugugcaccgagaccuaccucgacaccccccgccccaacgacggcuccaucaccggccccugcgaggccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120643 - RNA, 1401 nt, Artificial Sequence
  derived and/or modified sequence opt2 from neuraminidase__InfluenzaB__AGX16120
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120644 - RNA, 1401 nt, Artificial Sequence; identical to SEQ ID NO: 120643
  derived and/or modified sequence opt2 from neuraminidase__InfluenzaB__AGX16131

SEQ ID NO: 120645 - RNA, 1401 nt, Artificial Sequence; identical to SEQ ID NO: 120643
  derived and/or modified sequence opt2 from neuraminidase__InfluenzaB__AGX16142

SEQ ID NO: 120646 - RNA, 1401 nt, Artificial Sequence
  derived and/or modified sequence opt2 from neuraminidase__InfluenzaB__AGX16153
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccacccgcggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacaugaccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120647 - RNA, 1401 nt, Artificial Sequence; identical to SEQ ID NO: 120641
  derived and/or modified sequence opt2 from neuraminidase__InfluenzaB__AGX16164

SEQ ID NO: 120648 - RNA, 1401 nt, Artificial Sequence; identical to SEQ ID NO: 120300
  derived and/or modified sequence opt2 from neuraminidase__InfluenzaB__AGX16197

SEQ ID NO: 120649 - RNA, 1401 nt, Artificial Sequence; identical to SEQ ID NO: 120300
  derived and/or modified sequence opt2 from neuraminidase__InfluenzaB__AGX16208

SEQ ID NO: 120650 - RNA, 1401 nt, Artificial Sequence; identical to SEQ ID NO: 120300
  derived and/or modified sequence opt2 from neuraminidase__InfluenzaB__AGX16219

SEQ ID NO: 120651 - RNA, 1401 nt, Artificial Sequence; identical to SEQ ID NO: 120139
  derived and/or modified sequence opt2 from neuraminidase__InfluenzaB__AGX16230

SEQ ID NO: 120652 - RNA, 1401 nt, Artificial Sequence
  derived and/or modified sequence opt2 from neuraminidase__InfluenzaB__AGX16241
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaucggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucacccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120653 - RNA, 1401 nt, Artificial Sequence
  derived and/or modified sequence opt2 from neuraminidase__InfluenzaB__AGX16252
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgagugggccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120654 - RNA, 1401 nt, Artificial Sequence; identical to SEQ ID NO: 120300
  derived and/or modified sequence opt2 from neuraminidase__InfluenzaB__AGX16274

SEQ ID NO: 120655 - RNA, 1401 nt, Artificial Sequence
  derived and/or modified sequence opt2 from neuraminidase__InfluenzaB__AGX16285
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaccaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120656 - RNA, 1401 nt, Artificial Sequence; identical to SEQ ID NO: 120300
  derived and/or modified sequence opt2 from neuraminidase__InfluenzaB__AGX16296

SEQ ID NO: 120657 - RNA, 1401 nt, Artificial Sequence; identical to SEQ ID NO: 120147
  derived and/or modified sequence opt2 from neuraminidase__InfluenzaB__AGX16307

SEQ ID NO: 120658 - RNA, 1401 nt, Artificial Sequence; identical to SEQ ID NO: 120300
  derived and/or modified sequence opt2 from neuraminidase__InfluenzaB__AGX16329

SEQ ID NO: 120659 - RNA, 1401 nt, Artificial Sequence
  derived and/or modified sequence opt2 from neuraminidase__InfluenzaB__AGX16362
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120660 - RNA, 1401 nt, Artificial Sequence; identical to SEQ ID NO: 120472
  derived and/or modified sequence opt2 from neuraminidase__InfluenzaB__AGX16373

SEQ ID NO: 120661 - RNA, 1401 nt, Artificial Sequence
  derived and/or modified sequence opt2 from neuraminidase__InfluenzaB__AGX16384
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcucaagcaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120662 - RNA, 1401 nt, Artificial Sequence; identical to SEQ ID NO: 120329
  derived and/or modified sequence opt2 from neuraminidase__InfluenzaB__AGX16406

SEQ ID NO: 120663 - RNA, 1401 nt, Artificial Sequence; identical to SEQ ID NO: 120329
  derived and/or modified sequence opt2 from neuraminidase__InfluenzaB__AGX16427

SEQ ID NO: 120664 - RNA, 1401 nt, Artificial Sequence; identical to SEQ ID NO: 120329
  derived and/or modified sequence opt2 from neuraminidase__InfluenzaB__AGX16438

SEQ ID NO: 120665 - RNA, 1401 nt, Artificial Sequence; identical to SEQ ID NO: 120329
  derived and/or modified sequence opt2 from neuraminidase__InfluenzaB__AGX16449

SEQ ID NO: 120666 - RNA, 1401 nt, Artificial Sequence; identical to SEQ ID NO: 120329
  derived and/or modified sequence opt2 from neuraminidase__InfluenzaB__AGX16460

SEQ ID NO: 120667 - RNA, 1401 nt, Artificial Sequence
  derived and/or modified sequence opt2 from neuraminidase__InfluenzaB__AGX16471
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120668 - RNA, 1401 nt, Artificial Sequence; identical to SEQ ID NO: 120329
  derived and/or modified sequence opt2 from neuraminidase__InfluenzaB__AGX16482

SEQ ID NO: 120669 - RNA, 1401 nt, Artificial Sequence
  derived and/or modified sequence opt2 from neuraminidase__InfluenzaB__AGX16493
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucgucgucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120670 - RNA, 1401 nt, Artificial Sequence; identical to SEQ ID NO: 120128
  derived and/or modified sequence opt2 from neuraminidase__InfluenzaB__AGX16504

SEQ ID NO: 120671 - RNA, 1401 nt, Artificial Sequence; identical to SEQ ID NO: 120128
  derived and/or modified sequence opt2 from neuraminidase__InfluenzaB__AGX16515

SEQ ID NO: 120672 - RNA, 1401 nt, Artificial Sequence
  derived and/or modified sequence opt2 from neuraminidase__InfluenzaB__AGX16548
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaacggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120673 - RNA, 1401 nt, Artificial Sequence
  derived and/or modified sequence opt2 from neuraminidase__InfluenzaB__AGX16559
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120674 - RNA, 1401 nt, Artificial Sequence
  derived and/or modified sequence opt2 from neuraminidase__InfluenzaB__AGX16581
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120675 - RNA, 1401 nt, Artificial Sequence; identical to SEQ ID NO: 120674
  derived and/or modified sequence opt2 from neuraminidase__InfluenzaB__AGX16592

SEQ ID NO: 120676 - RNA, 1401 nt, Artificial Sequence; identical to SEQ ID NO: 120128
  derived and/or modified sequence opt2 from neuraminidase__InfluenzaB__AGX16603

SEQ ID NO: 120677 - RNA, 1401 nt, Artificial Sequence; identical to SEQ ID NO: 120194
  derived and/or modified sequence opt2 from neuraminidase__InfluenzaB__AGX16614

SEQ ID NO: 120678 - RNA, 1401 nt, Artificial Sequence; identical to SEQ ID NO: 120672
  derived and/or modified sequence opt2 from neuraminidase__InfluenzaB__AGX16625

SEQ ID NO: 120679 - RNA, 1401 nt, Artificial Sequence
  derived and/or modified sequence opt2 from neuraminidase__InfluenzaB__AGX16636
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucuggaacaccgucaccggcgucgacauggcccucuga

SEQ ID NO: 120680 - RNA, 1401 nt, Artificial Sequence; identical to SEQ ID NO: 120126
  derived and/or modified sequence opt2 from neuraminidase__InfluenzaB__AGX16647

SEQ ID NO: 120681 - RNA, 1401 nt, Artificial Sequence; identical to SEQ ID NO: 120674
  derived and/or modified sequence opt2 from neuraminidase__InfluenzaB__AGX16658

SEQ ID NO: 120682 - RNA, 1401 nt, Artificial Sequence; identical to SEQ ID NO: 120128
  derived and/or modified sequence opt2 from neuraminidase__InfluenzaB__AGX16669

SEQ ID NO: 120683 - RNA, 1401 nt, Artificial Sequence; identical to SEQ ID NO: 120194
  derived and/or modified sequence opt2 from neuraminidase__InfluenzaB__AGX16680

SEQ ID NO: 120684 - RNA, 1401 nt, Artificial Sequence; identical to SEQ ID NO: 120128
  derived and/or modified sequence opt2 from neuraminidase__InfluenzaB__AGX16691

SEQ ID NO: 120685 - RNA, 1401 nt, Artificial Sequence
  derived and/or modified sequence opt2 from neuraminidase__InfluenzaB__AGX16702
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120686 - RNA, 1401 nt, Artificial Sequence
  derived and/or modified sequence opt2 from neuraminidase__InfluenzaB__AGX16713
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaucuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120687 - RNA, 1401 nt, Artificial Sequence; identical to SEQ ID NO: 120128
  derived and/or modified sequence opt2 from neuraminidase__InfluenzaB__AGX16724

SEQ ID NO: 120688 - RNA, 1401 nt, Artificial Sequence; identical to SEQ ID NO: 120674
  derived and/or modified sequence opt2 from neuraminidase__InfluenzaB__AGX16735

SEQ ID NO: 120689 - RNA, 1401 nt, Artificial Sequence; identical to SEQ ID NO: 120674
  derived and/or modified sequence opt2 from neuraminidase__InfluenzaB__AGX16746

SEQ ID NO: 120690 - RNA, 1401 nt, Artificial Sequence; identical to SEQ ID NO: 120128
  derived and/or modified sequence opt2 from neuraminidase__InfluenzaB__AGX16757

SEQ ID NO: 120691 - RNA, 1401 nt, Artificial Sequence
  derived and/or modified sequence opt2 from neuraminidase__InfluenzaB__AGX16768
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcaaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120692 - RNA, 1401 nt, Artificial Sequence; identical to SEQ ID NO: 120194
  derived and/or modified sequence opt2 from neuraminidase__InfluenzaB__AGX16779

SEQ ID NO: 120693 - RNA, 1401 nt, Artificial Sequence
  derived and/or modified sequence opt2 from neuraminidase__InfluenzaB__AGX16790
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcggccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120694 - RNA, 1401 nt, Artificial Sequence
  derived and/or modified sequence opt2 from neuraminidase__InfluenzaB__AGX16801
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120695 - RNA, 1401 nt, Artificial Sequence; identical to SEQ ID NO: 120128
  derived and/or modified sequence opt2 from neuraminidase__InfluenzaB__AGX16812

SEQ ID NO: 120696 - RNA, 1401 nt, Artificial Sequence
  derived and/or modified sequence opt2 from neuraminidase__InfluenzaB__AGX16823
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgccgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120697 - RNA, 1401 nt, Artificial Sequence; identical to SEQ ID NO: 120128
  derived and/or modified sequence opt2 from neuraminidase__InfluenzaB__AGX16834

SEQ ID NO: 120698 - RNA, 1401 nt, Artificial Sequence
  derived and/or modified sequence opt2 from neuraminidase__InfluenzaB__AGX16845
augcuccccuccaccauccagacccucacccucuuccucaccuccggcggcguccuccucucccucuacgucuccgccucccucuccuaccuccucuacuccgacauccuccucaaguucucccccaccgagaucaccacccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucgucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120699 - RNA, 1401 nt, Artificial Sequence
  derived and/or modified sequence opt2 from neuraminidase__InfluenzaB__AGX16856
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccgucccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacuccggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaacaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120700 - RNA, 1401 nt, Artificial Sequence; identical to SEQ ID NO: 120128
  derived and/or modified sequence opt2 from neuraminidase__InfluenzaB__AGX16867

SEQ ID NO: 120701 - RNA, 1401 nt, Artificial Sequence
  derived and/or modified sequence opt2 from neuraminidase__InfluenzaB__AGX16878
augcuccccuccaccauccagacccucacccucuuccucaccuccggcggcguccuccucucccucuacgucuccgccucccucuccuaccuccucuacuccgacauccuccucaaguucucccccaccgagcucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaacggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120702 - RNA, 1401 nt, Artificial Sequence; identical to SEQ ID NO: 120674
  derived and/or modified sequence opt2 from neuraminidase__InfluenzaB__AGX16889

SEQ ID NO: 120703 - RNA, 1401 nt, Artificial Sequence
  derived and/or modified sequence opt2 from neuraminidase__InfluenzaB__AGX16900
augcuccccuccaccauccagacccucacccucuuccucaccaccggcggcguccuccucucccucuacgucuccgccucccucuccuaccuccucuacuccgacauccuccucaaguucucccccaccgagaucaucgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120704 - RNA, 1401 nt, Artificial Sequence
  derived and/or modified sequence opt2 from neuraminidase__InfluenzaB__AGX16911
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120705 - RNA, 1401 nt, Artificial Sequence
  derived and/or modified sequence opt2 from neuraminidase__InfluenzaB__AGX16922
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120706 - RNA, 1401 nt, Artificial Sequence
  derived and/or modified sequence opt2 from neuraminidase__InfluenzaB__AGX16933
augcuccccuccaccauccagacccucacccucuuccucaccuccggcggcguccuccucucccucuacgucuccgccucccucuccuaccuccucuacuccgacauccuccucaaguucucccccaccgagaucaacgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccuccucgacaccgucaccggcgucgacauggcccucuga

SEQ ID NO: 120707 - RNA, 1401 nt, Artificial Sequence
  derived and/or modified sequence opt2 from neuraminidase__InfluenzaB__AGX16944
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacuccggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaacaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120708 - RNA, 1401 nt, Artificial Sequence; identical to SEQ ID NO: 120128
  derived and/or modified sequence opt2 from neuraminidase__InfluenzaB__AGX16955

SEQ ID NO: 120709 - RNA, 1401 nt, Artificial Sequence; identical to SEQ ID NO: 120126
  derived and/or modified sequence opt2 from neuraminidase__InfluenzaB__AGX16966

SEQ ID NO: 120710 - RNA, 1401 nt, Artificial Sequence; identical to SEQ ID NO: 120128
  derived and/or modified sequence opt2 from neuraminidase__InfluenzaB__AGX16977

SEQ ID NO: 120711 - RNA, 1401 nt, Artificial Sequence; identical to SEQ ID NO: 120128
  derived and/or modified sequence opt2 from neuraminidase__InfluenzaB__AGX16988

SEQ ID NO: 120712 - RNA, 1401 nt, Artificial Sequence; identical to SEQ ID NO: 120672
  derived and/or modified sequence opt2 from neuraminidase__InfluenzaB__AGX16999

SEQ ID NO: 120713 - RNA, 1401 nt, Artificial Sequence; identical to SEQ ID NO: 120128
  derived and/or modified sequence opt2 from neuraminidase__InfluenzaB__AGX17010

SEQ ID NO: 120714 - RNA, 1401 nt, Artificial Sequence; identical to SEQ ID NO: 120674
  derived and/or modified sequence opt2 from neuraminidase__InfluenzaB__AGX17021

SEQ ID NO: 120715 - RNA, 1401 nt, Artificial Sequence
  derived and/or modified sequence opt2 from neuraminidase__InfluenzaB__AGX17032
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccgacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaaccgcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120716 - RNA, 1401 nt, Artificial Sequence; identical to SEQ ID NO: 120126
  derived and/or modified sequence opt2 from neuraminidase__InfluenzaB__AGX17043

SEQ ID NO: 120717 - RNA, 1401 nt, Artificial Sequence
  derived and/or modified sequence opt2 from neuraminidase__InfluenzaB__AGX17054
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaacggcaacggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120718 - RNA, 1401 nt, Artificial Sequence
  derived and/or modified sequence opt2 from neuraminidase__InfluenzaB__AGX17065
augcuccccuccaccauccagacccucacccucuuccucaccuccggcggcguccuccucucccucuacgucuccgcccuccucuccuaccuccucuacuccgacauccuccucaaguucucccccaccaagaucaucgcccccaccaccucccucgacuccgccaacgccuccaacuuccaggccgucaaccacuccgccaccaaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccaucuccaagaccaagcgcaugggcauggagcucuacgucaaguacgacggcgaccccuggaccgacuccgacgcccucgcccccuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120719 - RNA, 1401 nt, Artificial Sequence
  derived and/or modified sequence opt2 from neuraminidase__InfluenzaB__AGX17076
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaucguccacgacggcggcaaggagaccuggcacuccgccgccaccgccaucuacugccucaugggcuccggccagcuccucugggacaccgucaccggcgucgacauggcccucuga

SEQ ID NO: 120720 - RNA, 1401 nt, Artificial Sequence; identical to SEQ ID NO: 120674
  derived and/or modified sequence opt2 from neuraminidase__InfluenzaB__AGX17087

SEQ ID NO: 120721 - RNA, 1401 nt, Artificial Sequence; identical to SEQ ID NO: 120674
  derived and/or modified sequence opt2 from neuraminidase__InfluenzaB__AGX17098

SEQ ID NO: 120722 - RNA, 1401 nt, Artificial Sequence; identical to SEQ ID NO: 120674
  derived and/or modified sequence opt2 from neuraminidase__InfluenzaB__AGX17109

SEQ ID NO: 120723 - RNA, 1401 nt, Artificial Sequence; identical to SEQ ID NO: 120674
  derived and/or modified sequence opt2 from neuraminidase__InfluenzaB__AGX17120

SEQ ID NO: 120724 - RNA, 1401 nt, Artificial Sequence; identical to SEQ ID NO: 120126
  derived and/or modified sequence opt2 from neuraminidase__InfluenzaB__AGX17131

SEQ ID NO: 120725 - RNA, 1401 nt, Artificial Sequence; identical to SEQ ID NO: 120128
  derived and/or modified sequence opt2 from neuraminidase__InfluenzaB__AGX17142

SEQ ID NO: 120726 - RNA, 1401 nt, Artificial Sequence
  derived and/or modified sequence opt2 from neuraminidase__InfluenzaB__AGX17153
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaucggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120727 - RNA, 1401 nt, Artificial Sequence; identical to SEQ ID NO: 120674
  derived and/or modified sequence opt2 from neuraminidase__InfluenzaB__AGX17164

SEQ ID NO: 120728 - RNA, 1404 nt, Artificial Sequence
  derived and/or modified sequence opt2 from neuraminidase__InfluenzaB__AGX17175
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120729 - RNA, 1401 nt, Artificial Sequence
  derived and/or modified sequence opt2 from neuraminidase__InfluenzaB__AGX17186
augcuccccuccaccauccagacccucacccucuuccucaccuccggcggcguccuccucucccucuacgucuccgccucccucuccuaccuccucuacuccgacauccuccucaaguucucccccaccgagaucaccacccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaaguacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120730 - RNA, 1401 nt, Artificial Sequence; identical to SEQ ID NO: 120705
  derived and/or modified sequence opt2 from neuraminidase__InfluenzaB__AGX17197

SEQ ID NO: 120731 - RNA, 1401 nt, Artificial Sequence
  derived and/or modified sequence opt2 from neuraminidase__InfluenzaB__AGX17208
augcuccccuccaccauccagacccucacccucuuccucaccuccggcggcguccuccucucccucuacgucuccgccucccucuccuaccuccucuacuccgacauccuccucaaguucucccccaccgagaucaccacccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120732 - RNA, 1401 nt, Artificial Sequence; identical to SEQ ID NO: 120674
  derived and/or modified sequence opt2 from neuraminidase__InfluenzaB__AGX17219

SEQ ID NO: 120733 - RNA, 1401 nt, Artificial Sequence; identical to SEQ ID NO: 120128
  derived and/or modified sequence opt2 from neuraminidase__InfluenzaB__AGX17230

SEQ ID NO: 120734 - RNA, 1401 nt, Artificial Sequence; identical to SEQ ID NO: 120674
  derived and/or modified sequence opt2 from neuraminidase__InfluenzaB__AGX17241

SEQ ID NO: 120735 - RNA, 1401 nt, Artificial Sequence
  derived and/or modified sequence opt2 from neuraminidase__InfluenzaB__AGX17252
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcucgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucaccuacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgccgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120736 - RNA, 1401 nt, Artificial Sequence
  derived and/or modified sequence opt2 from neuraminidase__InfluenzaB__AGX17263
augcuccccuccaccauccagacccucacccucuuccucaccuccggcggcguccuccucucccucuacgucuccgccucccucuccuaccuccucuacuccgacauccuccucaagcucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120737 - RNA, 1401 nt, Artificial Sequence
  derived and/or modified sequence opt2 from neuraminidase__InfluenzaB__AGX17274
augcuccccuccaccauccagacccucacccucuuccucaccuccggcggcguccuccucucccucuacgucuccgccucccucuccuaccuccucuacuccgacauccuccucaaguucucccccaccgagaucaacgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120738 - RNA, 1401 nt, Artificial Sequence
  derived and/or modified sequence opt2 from neuraminidase__InfluenzaB__AGX17285
augcuccccuccaccauccagacccucacccucuuccucaccuccggcggcguccuccucucccucuacauguccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120739 - RNA, 1401 nt, Artificial Sequence
  derived and/or modified sequence opt2 from neuraminidase__InfluenzaB__AGX17296
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120740 - RNA, 1401 nt, Artificial Sequence; identical to SEQ ID NO: 120672
  derived and/or modified sequence opt2 from neuraminidase__InfluenzaB__AGX17307

SEQ ID NO: 120741 - RNA, 1401 nt, Artificial Sequence; identical to SEQ ID NO: 120126
  derived and/or modified sequence opt2 from neuraminidase__InfluenzaB__AGX17318

SEQ ID NO: 120742 - RNA, 1401 nt, Artificial Sequence
  derived and/or modified sequence opt2 from neuraminidase__InfluenzaB__AGX17329
augcuccccuccaccauccagacccucacccucuuccucaccuccggcggcguccuccucucccucuacgucuccgccucccucuccuaccuccucuacuccgacaugcuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacuccggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaacaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120743 - RNA, 1401 nt, Artificial Sequence; identical to SEQ ID NO: 120674
  derived and/or modified sequence opt2 from neuraminidase__InfluenzaB__AGX17340

SEQ ID NO: 120744 - RNA, 1401 nt, Artificial Sequence
  derived and/or modified sequence opt2 from neuraminidase__InfluenzaB__AGX17351
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgagaccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120745 - RNA, 1401 nt, Artificial Sequence
  derived and/or modified sequence opt2 from neuraminidase__InfluenzaB__AGX17362
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaucccccucgacugcgccaacgccuccaacauccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120746 - RNA, 1401 nt, Artificial Sequence
  derived and/or modified sequence opt2 from neuraminidase__InfluenzaB__AGX17373
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccaacaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120747 - RNA, 1401 nt, Artificial Sequence; identical to SEQ ID NO: 120126
  derived and/or modified sequence opt2 from neuraminidase__InfluenzaB__AGX17384

SEQ ID NO: 120748 - RNA, 1401 nt, Artificial Sequence; identical to SEQ ID NO: 120194
  derived and/or modified sequence opt2 from neuraminidase__InfluenzaB__AGX17395

SEQ ID NO: 120749 - RNA, 1401 nt, Artificial Sequence
  derived and/or modified sequence opt2 from neuraminidase__InfluenzaB__AGX17404
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggcuccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcaucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120750 - RNA, 1401 nt, Artificial Sequence
  derived and/or modified sequence opt2 from neuraminidase__InfluenzaB__AGX17415
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgacuggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120751 - RNA, 1401 nt, Artificial Sequence
  derived and/or modified sequence opt2 from neuraminidase__InfluenzaB__AGX17426
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120752 - RNA, 1401 nt, Artificial Sequence
  derived and/or modified sequence opt2 from neuraminidase__InfluenzaB__AGX17437
augcuccccuccaccauccagacccucacccucuuccucaccuccggcggcguccuccucucccucuacgucuccgucucccucuccuaccuccucuacuccgacauccuccucaaguucucccccaccgagaucaccgcccagaccaugccccucgacuucgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120753 - RNA, 1401 nt, Artificial Sequence
  derived and/or modified sequence opt2 from neuraminidase__InfluenzaB__AGX17448
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgagaccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucguccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120754 - RNA, 1401 nt, Artificial Sequence
  derived and/or modified sequence opt2 from neuraminidase__InfluenzaB__AGX17459
augcuccccuccaccauccagacccucacccucuuccucaccuccggcggcguccuccucucccucuacgucuccgccucccucuccuaccuccucuacuccgacauccuccucaaguucucccccaccgagaucaccgccuccaccaugccccucgacugcgccaacgccuccaacguccaggccgucaaccgcuccgccaccaagggcgucacccuccuccuccccgagcccgacuggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120755 - RNA, 1401 nt, Artificial Sequence; identical to SEQ ID NO: 120126
  derived and/or modified sequence opt2 from neuraminidase__InfluenzaB__AGX17470

SEQ ID NO: 120756 - RNA, 1401 nt, Artificial Sequence
  derived and/or modified sequence opt2 from neuraminidase__InfluenzaB__AGX17481
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccucauccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccgucgaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120757 - RNA, 1401 nt, Artificial Sequence
  derived and/or modified sequence opt2 from neuraminidase__InfluenzaB__AGX17492
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacaucgcccucuga

SEQ ID NO: 120758 - RNA, 1401 nt, Artificial Sequence
  derived and/or modified sequence opt2 from neuraminidase__InfluenzaB__AGX17503
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggccucaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120759 - RNA, 1401 nt, Artificial Sequence; identical to SEQ ID NO: 120126
  derived and/or modified sequence opt2 from neuraminidase__InfluenzaB__AGX17514

SEQ ID NO: 120760 - RNA, 1401 nt, Artificial Sequence
  derived and/or modified sequence opt2 from neuraminidase__InfluenzaB__AGX17525
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120761 - RNA, 1401 nt, Artificial Sequence; identical to SEQ ID NO: 120705
  derived and/or modified sequence opt2 from neuraminidase__InfluenzaB__AGX17536

SEQ ID NO: 120762 - RNA, 1401 nt, Artificial Sequence; identical to SEQ ID NO: 120736
  derived and/or modified sequence opt2 from neuraminidase__InfluenzaB__AGX17547

SEQ ID NO: 120763 - RNA, 1401 nt, Artificial Sequence
  derived and/or modified sequence opt2 from neuraminidase__InfluenzaB__AGX17558
augcuccccuccaccauccagacccucacccucuuccucaccuccggcggcguccuccucucccucuacgucuccgccucccucuccuaccuccucuacuccgacguccuccucaaguucucccccgccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120764 - RNA, 1401 nt, Artificial Sequence; identical to SEQ ID NO: 120255
  derived and/or modified sequence opt2 from neuraminidase__InfluenzaB__AGX17569

SEQ ID NO: 120765 - RNA, 1401 nt, Artificial Sequence; identical to SEQ ID NO: 120182
  derived and/or modified sequence opt2 from neuraminidase__InfluenzaB__AGX17580

SEQ ID NO: 120766 - RNA, 1401 nt, Artificial Sequence
  derived and/or modified sequence opt2 from neuraminidase__InfluenzaB__AGX17591
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120767 - RNA, 1401 nt, Artificial Sequence; identical to SEQ ID NO: 120180
  derived and/or modified sequence opt2 from neuraminidase__InfluenzaB__AGX17602

SEQ ID NO: 120768 - RNA, 1401 nt, Artificial Sequence; identical to SEQ ID NO: 120766
  derived and/or modified sequence opt2 from neuraminidase__InfluenzaB__AGX17613

SEQ ID NO: 120769 - RNA, 1401 nt, Artificial Sequence; identical to SEQ ID NO: 120353
  derived and/or modified sequence opt2 from neuraminidase__InfluenzaB__AGX17624

SEQ ID NO: 120770 - RNA, 1401 nt, Artificial Sequence
  derived and/or modified sequence opt2 from neuraminidase__InfluenzaB__AGX17635
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120771 - RNA, 1401 nt, Artificial Sequence; identical to SEQ ID NO: 120353
  derived and/or modified sequence opt2 from neuraminidase__InfluenzaB__AGX17657

SEQ ID NO: 120772 - RNA, 1401 nt, Artificial Sequence; identical to SEQ ID NO: 120766
  derived and/or modified sequence opt2 from neuraminidase__InfluenzaB__AGX17668

SEQ ID NO: 120773 - RNA, 1401 nt, Artificial Sequence
  derived and/or modified sequence opt2 from neuraminidase__InfluenzaB__AGX17679
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120774 - RNA, 1401 nt, Artificial Sequence; identical to SEQ ID NO: 120353
  derived and/or modified sequence opt2 from neuraminidase__InfluenzaB__AGX17690

SEQ ID NO: 120775 - RNA, 1401 nt, Artificial Sequence
  derived and/or modified sequence opt2 from neuraminidase__InfluenzaB__AGX17701
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120776 - RNA, 1401 nt, Artificial Sequence; identical to SEQ ID NO: 120353
  derived and/or modified sequence opt2 from neuraminidase__InfluenzaB__AGX17723

SEQ ID NO: 120777 - RNA, 1401 nt, Artificial Sequence; identical to SEQ ID NO: 120773
  derived and/or modified sequence opt2 from neuraminidase__InfluenzaB__AGX17734

SEQ ID NO: 120778 - RNA, 1401 nt, Artificial Sequence
  derived and/or modified sequence opt2 from neuraminidase__InfluenzaB__AGX17745
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugcuccggcuccaccuuccagaaggcccuccucaucuccccccaccgcuucggcgagaucaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120779 - RNA, 1401 nt, Artificial Sequence
  derived and/or modified sequence opt2 from neuraminidase__InfluenzaB__AGX17756
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccgccccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120780 - RNA, 1401 nt, Artificial Sequence; identical to SEQ ID NO: 120400
  derived and/or modified sequence opt2 from neuraminidase__InfluenzaB__AGX17767

SEQ ID NO: 120781 - RNA, 1401 nt, Artificial Sequence
  derived and/or modified sequence opt2 from neuraminidase__InfluenzaB__AGX17778
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgaguccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120782 - RNA, 1401 nt, Artificial Sequence
  derived and/or modified sequence opt2 from neuraminidase__InfluenzaB__AGX17789
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120783 - RNA, 1401 nt, Artificial Sequence; identical to SEQ ID NO: 120353
  derived and/or modified sequence opt2 from neuraminidase__InfluenzaB__AGX17800

SEQ ID NO: 120784 - RNA, 1401 nt, Artificial Sequence
  derived and/or modified sequence opt2 from neuraminidase__InfluenzaB__AGX17811
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccaguga

SEQ ID NO: 120785 - RNA, 1401 nt, Artificial Sequence; identical to SEQ ID NO: 120766
  derived and/or modified sequence opt2 from neuraminidase__InfluenzaB__AGX17822

SEQ ID NO: 120786 - RNA, 1401 nt, Artificial Sequence
  derived and/or modified sequence opt2 from neuraminidase__InfluenzaB__AGX17833
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccaucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120787 - RNA, 1401 nt, Artificial Sequence; identical to SEQ ID NO: 120773
  derived and/or modified sequence opt2 from neuraminidase__InfluenzaB__AGX17844

SEQ ID NO: 120788 - RNA, 1401 nt, Artificial Sequence; identical to SEQ ID NO: 120781
  derived and/or modified sequence opt2 from neuraminidase__InfluenzaB__AGX17855

SEQ ID NO: 120789 - RNA, 1401 nt, Artificial Sequence; identical to SEQ ID NO: 120400
  derived and/or modified sequence opt2 from neuraminidase__InfluenzaB__AGX17866

SEQ ID NO: 120790 - RNA, 1401 nt, Artificial Sequence; identical to SEQ ID NO: 120766
  derived and/or modified sequence opt2 from neuraminidase__InfluenzaB__AGX17877

SEQ ID NO: 120791 - RNA, 1401 nt, Artificial Sequence; identical to SEQ ID NO: 120773
  derived and/or modified sequence opt2 from neuraminidase__InfluenzaB__AGX17888

SEQ ID NO: 120792 - RNA, 1401 nt, Artificial Sequence; identical to SEQ ID NO: 120766
  derived and/or modified sequence opt2 from neuraminidase__InfluenzaB__AGX17899

SEQ ID NO: 120793 - RNA, 1401 nt, Artificial Sequence; identical to SEQ ID NO: 120773
  derived and/or modified sequence opt2 from neuraminidase__InfluenzaB__AGX17910

SEQ ID NO: 120794 - RNA, 1401 nt, Artificial Sequence; identical to SEQ ID NO: 120773
  derived and/or modified sequence opt2 from neuraminidase__InfluenzaB__AGX17921

SEQ ID NO: 120795 - RNA, 1401 nt, Artificial Sequence; identical to SEQ ID NO: 120400
  derived and/or modified sequence opt2 from neuraminidase__InfluenzaB__AGX17932

SEQ ID NO: 120796 - RNA, 1401 nt, Artificial Sequence
  derived and/or modified sequence opt2 from neuraminidase__InfluenzaB__AGX17943
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccguccgccucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120797 - RNA, 1401 nt, Artificial Sequence; identical to SEQ ID NO: 120766
  derived and/or modified sequence opt2 from neuraminidase__InfluenzaB__AGX17954

SEQ ID NO: 120798 - RNA, 1401 nt, Artificial Sequence
  derived and/or modified sequence opt2 from neuraminidase__InfluenzaB__AGX17976
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120799 - RNA, 1401 nt, Artificial Sequence
  derived and/or modified sequence opt2 from neuraminidase__InfluenzaB__AGX17987
augcuccccuccaccauccagacccucacccucuuccucaccuccggcggcguccuccucucccucuacgucuccgucucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120800 - RNA, 1401 nt, Artificial Sequence; identical to SEQ ID NO: 120773
  derived and/or modified sequence opt2 from neuraminidase__InfluenzaB__AGX17998

SEQ ID NO: 120801 - RNA, 1401 nt, Artificial Sequence; identical to SEQ ID NO: 120766
  derived and/or modified sequence opt2 from neuraminidase__InfluenzaB__AGX18009

SEQ ID NO: 120802 - RNA, 1401 nt, Artificial Sequence; identical to SEQ ID NO: 120799
  derived and/or modified sequence opt2 from neuraminidase__InfluenzaB__AGX18020

SEQ ID NO: 120803 - RNA, 1401 nt, Artificial Sequence; identical to SEQ ID NO: 120766
  derived and/or modified sequence opt2 from neuraminidase__InfluenzaB__AGX18031

SEQ ID NO: 120804 - RNA, 1401 nt, Artificial Sequence
  derived and/or modified sequence opt2 from neuraminidase__InfluenzaB__AGX18042
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucaacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120805 - RNA, 1401 nt, Artificial Sequence; identical to SEQ ID NO: 120773
  derived and/or modified sequence opt2 from neuraminidase__InfluenzaB__AGX18053

SEQ ID NO: 120806 - RNA, 1401 nt, Artificial Sequence; identical to SEQ ID NO: 120773
  derived and/or modified sequence opt2 from neuraminidase__InfluenzaB__AGX18064

SEQ ID NO: 120807 - RNA, 1401 nt, Artificial Sequence
  derived and/or modified sequence opt2 from neuraminidase__InfluenzaB__AGX18075
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccuccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120808 - RNA, 1401 nt, Artificial Sequence; identical to SEQ ID NO: 120400
  derived and/or modified sequence opt2 from neuraminidase__InfluenzaB__AGX18086

SEQ ID NO: 120809 - RNA, 1401 nt, Artificial Sequence; identical to SEQ ID NO: 120400
  derived and/or modified sequence opt2 from neuraminidase__InfluenzaB__AGX18097

SEQ ID NO: 120810 - RNA, 1401 nt, Artificial Sequence; identical to SEQ ID NO: 120353
  derived and/or modified sequence opt2 from neuraminidase__InfluenzaB__AGX18108

SEQ ID NO: 120811 - RNA, 1401 nt, Artificial Sequence
  derived and/or modified sequence opt2 from neuraminidase__InfluenzaB__AGX18119
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacaccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacauggagaccgacaccgccgagaucaagcucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120812 - RNA, 1401 nt, Artificial Sequence
  derived and/or modified sequence opt2 from neuraminidase__InfluenzaB__AGX18130
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccaugucccgcaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120813 - RNA, 1401 nt, Artificial Sequence
  derived and/or modified sequence opt2 from neuraminidase__InfluenzaB__AGX18141
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcaugacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgaguccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120814 - RNA, 1401 nt, Artificial Sequence; identical to SEQ ID NO: 120400
  derived and/or modified sequence opt2 from neuraminidase__InfluenzaB__AGX18152

SEQ ID NO: 120815 - RNA, 1401 nt, Artificial Sequence
  derived and/or modified sequence opt2 from neuraminidase__InfluenzaB__AGX18163
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120816 - RNA, 1401 nt, Artificial Sequence; identical to SEQ ID NO: 120766
  derived and/or modified sequence opt2 from neuraminidase__InfluenzaB__AGX18174

SEQ ID NO: 120817 - RNA, 1401 nt, Artificial Sequence; identical to SEQ ID NO: 120400
  derived and/or modified sequence opt2 from neuraminidase__InfluenzaB__AGX18185

SEQ ID NO: 120818 - RNA, 1401 nt, Artificial Sequence; identical to SEQ ID NO: 120353
  derived and/or modified sequence opt2 from neuraminidase__InfluenzaB__AGX18196

SEQ ID NO: 120819 - RNA, 1401 nt, Artificial Sequence
  derived and/or modified sequence opt2 from neuraminidase__InfluenzaB__AGX18207
augcuccccuccaccauccagacccucacccucuuccucaccuccggcggcguccuccucucccucuacgucuccgccucccucuccuaccuccucuacuccgacauccuccucaaguucccccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaccuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120820 - RNA, 1401 nt, Artificial Sequence
  derived and/or modified sequence opt2 from neuraminidase__InfluenzaB__AGX18218
augcuccccuccaccauccagacccucacccucuuccucaccuccggcggcguccuccucucccucuacgucuccgccucccucuccuaccuccucuacuccgacauccuccucaagcucucccccaccgagaucaccgcccccaccaugccccucgacugcgccaacaccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaaccgcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacauggagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120821 - RNA, 1401 nt, Artificial Sequence; identical to SEQ ID NO: 120773
  derived and/or modified sequence opt2 from neuraminidase__InfluenzaB__AGX18229

SEQ ID NO: 120822 - RNA, 1401 nt, Artificial Sequence
  derived and/or modified sequence opt2 from neuraminidase__InfluenzaB__AGX18240
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccagaccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120823 - RNA, 1401 nt, Artificial Sequence; identical to SEQ ID NO: 120766
  derived and/or modified sequence opt2 from neuraminidase__InfluenzaB__AGX18251

SEQ ID NO: 120824 - RNA, 1401 nt, Artificial Sequence
  derived and/or modified sequence opt2 from neuraminidase__InfluenzaB__AGX18262
augcuccccuccaccauccagacccucacccucuuccucaccuccggcggcguccuccucucccucuacgucuccgccucccucuccuaccuccucuacuccaacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaaggucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120825 - RNA, 1401 nt, Artificial Sequence; identical to SEQ ID NO: 120773
  derived and/or modified sequence opt2 from neuraminidase__InfluenzaB__AGX18273

SEQ ID NO: 120826 - RNA, 1401 nt, Artificial Sequence; identical to SEQ ID NO: 120798
  derived and/or modified sequence opt2 from neuraminidase__InfluenzaB__AGX18284

SEQ ID NO: 120827 - RNA, 1401 nt, Artificial Sequence; identical to SEQ ID NO: 120773
  derived and/or modified sequence opt2 from neuraminidase__InfluenzaB__AGX18295

SEQ ID NO: 120828 - RNA, 1401 nt, Artificial Sequence; identical to SEQ ID NO: 120400
  derived and/or modified sequence opt2 from neuraminidase__InfluenzaB__AGX18306

SEQ ID NO: 120829 - RNA, 1401 nt, Artificial Sequence
  derived and/or modified sequence opt2 from neuraminidase__InfluenzaB__AGX18317
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacgagacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120830 - RNA, 1401 nt, Artificial Sequence; identical to SEQ ID NO: 120773
  derived and/or modified sequence opt2 from neuraminidase__InfluenzaB__AGX18328

SEQ ID NO: 120831 - RNA, 1401 nt, Artificial Sequence
  derived and/or modified sequence opt2 from neuraminidase__InfluenzaB__AGX18339
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaaggucggccgcugguacucccgcaccauguccaagaccgagcgcaugggcaugggccucuacgucaaguacgacggcgaccccugggccgacuccgacgcccucgccuucggcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120832 - RNA, 1401 nt, Artificial Sequence
  derived and/or modified sequence opt2 from neuraminidase__InfluenzaB__AGX18350
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccaugaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120833 - RNA, 1401 nt, Artificial Sequence; identical to SEQ ID NO: 120798
  derived and/or modified sequence opt2 from neuraminidase__InfluenzaB__AGX18361

SEQ ID NO: 120834 - RNA, 1401 nt, Artificial Sequence
  derived and/or modified sequence opt2 from neuraminidase__InfluenzaB__AGX18383
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacaccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacauggagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacggcggcggcaaggagaccuggcacuccgccgccaccgccaucuacugccucaugggcuccggccagcuccucugggacaccgucaccggcgucgacauggcccucuga

SEQ ID NO: 120835 - RNA, 1401 nt, Artificial Sequence; identical to SEQ ID NO: 120400
  derived and/or modified sequence opt2 from neuraminidase__InfluenzaB__AGX18394

SEQ ID NO: 120836 - RNA, 1401 nt, Artificial Sequence
  derived and/or modified sequence opt2 from neuraminidase__InfluenzaB__AGX18405
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgucugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120837 - RNA, 1401 nt, Artificial Sequence
  derived and/or modified sequence opt2 from neuraminidase__InfluenzaB__AGX18416
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggcuccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120838 - RNA, 1401 nt, Artificial Sequence
  derived and/or modified sequence opt2 from neuraminidase__InfluenzaB__AGX18428
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120839 - RNA, 1401 nt, Artificial Sequence
  derived and/or modified sequence opt2 from neuraminidase__InfluenzaB__AGX18439
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggccucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120840 - RNA, 1401 nt, Artificial Sequence
  derived and/or modified sequence opt2 from neuraminidase__InfluenzaB__AGX18450
augcuccccuccaccauccagacccucacccucuuccucaccuccggcggcguccuccucucccucuacgucuccgccucccucuccuaccuccucuacuccgacauccuccucaaguucucccccaccgagaucaccgccuccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaucgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120841 - RNA, 1401 nt, Artificial Sequence; identical to SEQ ID NO: 120400
  derived and/or modified sequence opt2 from neuraminidase__InfluenzaB__AGX18461

SEQ ID NO: 120842 - RNA, 1401 nt, Artificial Sequence
  derived and/or modified sequence opt2 from neuraminidase__InfluenzaB__AGX18472
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccacuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120843 - RNA, 1401 nt, Artificial Sequence; identical to SEQ ID NO: 120400
  derived and/or modified sequence opt2 from neuraminidase__InfluenzaB__AGX18483

SEQ ID NO: 120844 - RNA, 1401 nt, Artificial Sequence; identical to SEQ ID NO: 120147
  derived and/or modified sequence opt2 from neuraminidase__InfluenzaB__AGX18494

SEQ ID NO: 120845 - RNA, 1401 nt, Artificial Sequence
  derived and/or modified sequence opt2 from neuraminidase__InfluenzaB__AGX18505
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccaucuccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120846 - RNA, 1401 nt, Artificial Sequence
  derived and/or modified sequence opt2 from neuraminidase__InfluenzaB__AGX18516
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccaucuccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacggcggcggcaaggagaccuggcacuccgccgccaccgccaucuacugccucaugggcuccggccagcuccucugggacaccgucaccggcgucgacauggcccucuga

SEQ ID NO: 120847 - RNA, 1401 nt, Artificial Sequence; identical to SEQ ID NO: 120147
  derived and/or modified sequence opt2 from neuraminidase__InfluenzaB__AGX18527

SEQ ID NO: 120848 - RNA, 1401 nt, Artificial Sequence; identical to SEQ ID NO: 120147
  derived and/or modified sequence opt2 from neuraminidase__InfluenzaB__AGX18538

SEQ ID NO: 120849 - RNA, 1401 nt, Artificial Sequence; identical to SEQ ID NO: 120147
  derived and/or modified sequence opt2 from neuraminidase__InfluenzaB__AGX18549

SEQ ID NO: 120850 - RNA, 1401 nt, Artificial Sequence; identical to SEQ ID NO: 120147
  derived and/or modified sequence opt2 from neuraminidase__InfluenzaB__AGX18560

SEQ ID NO: 120851 - RNA, 1401 nt, Artificial Sequence; identical to SEQ ID NO: 120147
  derived and/or modified sequence opt2 from neuraminidase__InfluenzaB__AGX18571

SEQ ID NO: 120852 - RNA, 1401 nt, Artificial Sequence
  derived and/or modified sequence opt2 from neuraminidase__InfluenzaB__AGX18582
augcuccccuccaccauccagacccucacccucuuccucaccuccggcggcguccuccucucccucuacguccucgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgagugggccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120853 - RNA, 1401 nt, Artificial Sequence; identical to SEQ ID NO: 120147
  derived and/or modified sequence opt2 from neuraminidase__InfluenzaB__AGX18593

SEQ ID NO: 120854 - RNA, 1401 nt, Artificial Sequence; identical to SEQ ID NO: 120147
  derived and/or modified sequence opt2 from neuraminidase__InfluenzaB__AGX18604

SEQ ID NO: 120855 - RNA, 1401 nt, Artificial Sequence
  derived and/or modified sequence opt2 from neuraminidase__InfluenzaB__AGX18615
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120856 - RNA, 1401 nt, Artificial Sequence
  derived and/or modified sequence opt2 from neuraminidase__InfluenzaB__AGX18626
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucauccuccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120857 - RNA, 1401 nt, Artificial Sequence; identical to SEQ ID NO: 120147
  derived and/or modified sequence opt2 from neuraminidase__InfluenzaB__AGX18637

SEQ ID NO: 120858 - RNA, 1401 nt, Artificial Sequence; identical to SEQ ID NO: 120147
  derived and/or modified sequence opt2 from neuraminidase__InfluenzaB__AGX18648

SEQ ID NO: 120859 - RNA, 1401 nt, Artificial Sequence; identical to SEQ ID NO: 120147
  derived and/or modified sequence opt2 from neuraminidase__InfluenzaB__AGX18659

SEQ ID NO: 120860 - RNA, 1401 nt, Artificial Sequence; identical to SEQ ID NO: 120147
  derived and/or modified sequence opt2 from neuraminidase__InfluenzaB__AGX18670

SEQ ID NO: 120861 - RNA, 1401 nt, Artificial Sequence
  derived and/or modified sequence opt2 from neuraminidase__InfluenzaB__AGX18681
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucguccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120862 - RNA, 1401 nt, Artificial Sequence; identical to SEQ ID NO: 120147
  derived and/or modified sequence opt2 from neuraminidase__InfluenzaB__AGX18692

SEQ ID NO: 120863 - RNA, 1401 nt, Artificial Sequence
  derived and/or modified sequence opt2 from neuraminidase__InfluenzaB__AGX18703
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccucuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120864 - RNA, 1401 nt, Artificial Sequence; identical to SEQ ID NO: 120147
  derived and/or modified sequence opt2 from neuraminidase__InfluenzaB__AGX18714

SEQ ID NO: 120865 - RNA, 1401 nt, Artificial Sequence; identical to SEQ ID NO: 120147
  derived and/or modified sequence opt2 from neuraminidase__InfluenzaB__AGX18725

SEQ ID NO: 120866 - RNA, 1401 nt, Artificial Sequence
  derived and/or modified sequence opt2 from neuraminidase__InfluenzaB__AGX18736
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcaccggcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120867 - RNA, 1401 nt, Artificial Sequence; identical to SEQ ID NO: 120147
  derived and/or modified sequence opt2 from neuraminidase__InfluenzaB__AGX18758

SEQ ID NO: 120868 - RNA, 1401 nt, Artificial Sequence; identical to SEQ ID NO: 120147
  derived and/or modified sequence opt2 from neuraminidase__InfluenzaB__AGX18769

SEQ ID NO: 120869 - RNA, 1401 nt, Artificial Sequence; identical to SEQ ID NO: 120606
  derived and/or modified sequence opt2 from neuraminidase__InfluenzaB__AGX18780

SEQ ID NO: 120870 - RNA, 1401 nt, Artificial Sequence; identical to SEQ ID NO: 120147
  derived and/or modified sequence opt2 from neuraminidase__InfluenzaB__AGX18791

SEQ ID NO: 120871 - RNA, 1401 nt, Artificial Sequence; identical to SEQ ID NO: 120147
  derived and/or modified sequence opt2 from neuraminidase__InfluenzaB__AGX18802

SEQ ID NO: 120872 - RNA, 1401 nt, Artificial Sequence
  derived and/or modified sequence opt2 from neuraminidase__InfluenzaB__AGX18813
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgucuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120873 - RNA, 1401 nt, Artificial Sequence; identical to SEQ ID NO: 120606
  derived and/or modified sequence opt2 from neuraminidase__InfluenzaB__AGX18824

SEQ ID NO: 120874 - RNA, 1401 nt, Artificial Sequence
  derived and/or modified sequence opt2 from neuraminidase__InfluenzaB__AGX18846
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccucuccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120875 - RNA, 1401 nt, Artificial Sequence; identical to SEQ ID NO: 120147
  derived and/or modified sequence opt2 from neuraminidase__InfluenzaB__AGX18857

SEQ ID NO: 120876 - RNA, 1401 nt, Artificial Sequence; identical to SEQ ID NO: 120874
  derived and/or modified sequence opt2 from neuraminidase__InfluenzaB__AGX18868

SEQ ID NO: 120877 - RNA, 1401 nt, Artificial Sequence; identical to SEQ ID NO: 120874
  derived and/or modified sequence opt2 from neuraminidase__InfluenzaB__AGX18879

SEQ ID NO: 120878 - RNA, 1401 nt, Artificial Sequence
  derived and/or modified sequence opt2 from neuraminidase__InfluenzaB__AGX18890
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccaccaucuacugccucaugggcuccggccagcuccucugggacaccgucaccggcgucaacauggcccucuga

SEQ ID NO: 120879 - RNA, 1401 nt, Artificial Sequence; identical to SEQ ID NO: 120147
  derived and/or modified sequence opt2 from neuraminidase__InfluenzaB__AGX18912

SEQ ID NO: 120880 - RNA, 1401 nt, Artificial Sequence
  derived and/or modified sequence opt2 from neuraminidase__InfluenzaB__AGX18923
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaaccgcacccgcggcgaccgcaacaagcuccgccaccucaucuccgucaagcucggcaagauccccaccgucgagaacuccaucuuccacauggccgccugguccggcuccgccugccacgacggcaaggaguggaucuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120881 - RNA, 1401 nt, Artificial Sequence; identical to SEQ ID NO: 120147
  derived and/or modified sequence opt2 from neuraminidase__InfluenzaB__AGX18934

SEQ ID NO: 120882 - RNA, 1401 nt, Artificial Sequence
  derived and/or modified sequence opt2 from neuraminidase__InfluenzaB__AGX18956
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacgucgccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120883 - RNA, 1401 nt, Artificial Sequence
  derived and/or modified sequence opt2 from neuraminidase__InfluenzaB__AGX18967
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120884 - RNA, 1401 nt, Artificial Sequence; identical to SEQ ID NO: 120606
  derived and/or modified sequence opt2 from neuraminidase__InfluenzaB__AGX18978

SEQ ID NO: 120885 - RNA, 1401 nt, Artificial Sequence
  derived and/or modified sequence opt2 from neuraminidase__InfluenzaB__AGX18989
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacuacgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaccaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120886 - RNA, 1401 nt, Artificial Sequence
  derived and/or modified sequence opt2 from neuraminidase__InfluenzaB__AGX19000
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucaccuacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120887 - RNA, 1401 nt, Artificial Sequence; identical to SEQ ID NO: 120147
  derived and/or modified sequence opt2 from neuraminidase__InfluenzaB__AGX19011

SEQ ID NO: 120888 - RNA, 1401 nt, Artificial Sequence; identical to SEQ ID NO: 120147
  derived and/or modified sequence opt2 from neuraminidase__InfluenzaB__AGX19022

SEQ ID NO: 120889 - RNA, 1401 nt, Artificial Sequence
  derived and/or modified sequence opt2 from neuraminidase__InfluenzaB__AGX19033
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucaacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccgagggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120890 - RNA, 1401 nt, Artificial Sequence; identical to SEQ ID NO: 120147
  derived and/or modified sequence opt2 from neuraminidase__InfluenzaB__AGX19044

SEQ ID NO: 120891 - RNA, 1401 nt, Artificial Sequence; identical to SEQ ID NO: 120147
  derived and/or modified sequence opt2 from neuraminidase__InfluenzaB__AGX19055

SEQ ID NO: 120892 - RNA, 1401 nt, Artificial Sequence
  derived and/or modified sequence opt2 from neuraminidase__InfluenzaB__AGX19066
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaucuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120893 - RNA, 1401 nt, Artificial Sequence
  derived and/or modified sequence opt2 from neuraminidase__InfluenzaB__AGX19077
augcuccccuccaccauccagacccucacccucuuccucaccuccggcggcguccuccucucccucuacgucuccgccucccucuccuaccuccucuacuccgacauccuccucaaguucacccccaccgagaucaccgcccccaccaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120894 - RNA, 1401 nt, Artificial Sequence
  derived and/or modified sequence opt2 from neuraminidase__InfluenzaB__AGX19088
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucgucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120895 - RNA, 1401 nt, Artificial Sequence; identical to SEQ ID NO: 120147
  derived and/or modified sequence opt2 from neuraminidase__InfluenzaB__AGX19099

SEQ ID NO: 120896 - RNA, 1401 nt, Artificial Sequence
  derived and/or modified sequence opt2 from neuraminidase__InfluenzaB__AGX19110
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucaucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgucuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120897 - RNA, 1401 nt, Artificial Sequence
  derived and/or modified sequence opt2 from neuraminidase__InfluenzaB__AGX19121
augcuccccuccaccacccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120898 - RNA, 1401 nt, Artificial Sequence; identical to SEQ ID NO: 120781
  derived and/or modified sequence opt2 from neuraminidase__InfluenzaB__AGX19132

SEQ ID NO: 120899 - RNA, 1401 nt, Artificial Sequence; identical to SEQ ID NO: 120885
  derived and/or modified sequence opt2 from neuraminidase__InfluenzaB__AGX19143

SEQ ID NO: 120900 - RNA, 1401 nt, Artificial Sequence
  derived and/or modified sequence opt2 from neuraminidase__InfluenzaB__AGX19154
augcuccccuccaccauccagacccucacccucuuccucaccuccggcggcguccuccucucccucuacgucuccgccucccucuccuaccuccucuacuccaacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120901 - RNA, 1401 nt, Artificial Sequence; identical to SEQ ID NO: 120147
  derived and/or modified sequence opt2 from neuraminidase__InfluenzaB__AGX19165

SEQ ID NO: 120902 - RNA, 1401 nt, Artificial Sequence
  derived and/or modified sequence opt2 from neuraminidase__InfluenzaB__AGX19176
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaaccgcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120903 - RNA, 1401 nt, Artificial Sequence
  derived and/or modified sequence opt2 from neuraminidase__InfluenzaB__AGX19187
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugcuccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120904 - RNA, 1401 nt, Artificial Sequence
  derived and/or modified sequence opt2 from neuraminidase__InfluenzaB__AGX19198
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacuacgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120905 - RNA, 1401 nt, Artificial Sequence; identical to SEQ ID NO: 120885
  derived and/or modified sequence opt2 from neuraminidase__InfluenzaB__AGX19209

SEQ ID NO: 120906 - RNA, 1401 nt, Artificial Sequence
  derived and/or modified sequence opt2 from neuraminidase__InfluenzaB__AGX19220
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgaccgcggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120907 - RNA, 1401 nt, Artificial Sequence; identical to SEQ ID NO: 120353
  derived and/or modified sequence opt2 from neuraminidase__InfluenzaB__AGX19231

SEQ ID NO: 120908 - RNA, 1401 nt, Artificial Sequence
  derived and/or modified sequence opt2 from neuraminidase__InfluenzaB__AGX19253
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacucccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120909 - RNA, 1401 nt, Artificial Sequence; identical to SEQ ID NO: 120883
  derived and/or modified sequence opt2 from neuraminidase__InfluenzaB__AGX19264

SEQ ID NO: 120910 - RNA, 1401 nt, Artificial Sequence; identical to SEQ ID NO: 120147
  derived and/or modified sequence opt2 from neuraminidase__InfluenzaB__AGX19275

SEQ ID NO: 120911 - RNA, 1401 nt, Artificial Sequence
  derived and/or modified sequence opt2 from neuraminidase__InfluenzaB__AGX19286
augauccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120912 - RNA, 1401 nt, Artificial Sequence
  derived and/or modified sequence opt2 from neuraminidase__InfluenzaB__AGX19297
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120913 - RNA, 1401 nt, Artificial Sequence; identical to SEQ ID NO: 120912
  derived and/or modified sequence opt2 from neuraminidase__InfluenzaB__AGX19308

SEQ ID NO: 120914 - RNA, 1401 nt, Artificial Sequence; identical to SEQ ID NO: 120912
  derived and/or modified sequence opt2 from neuraminidase__InfluenzaB__AGX19319

SEQ ID NO: 120915 - RNA, 1401 nt, Artificial Sequence
  derived and/or modified sequence opt2 from neuraminidase__InfluenzaB__AGX19330
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcaaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120916 - RNA, 1401 nt, Artificial Sequence; identical to SEQ ID NO: 120912
  derived and/or modified sequence opt2 from neuraminidase__InfluenzaB__AGX19341

SEQ ID NO: 120917 - RNA, 1401 nt, Artificial Sequence; identical to SEQ ID NO: 120912
  derived and/or modified sequence opt2 from neuraminidase__InfluenzaB__AGX19352

SEQ ID NO: 120918 - RNA, 1401 nt, Artificial Sequence
  derived and/or modified sequence opt2 from neuraminidase__InfluenzaB__AGX19363
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucaccuacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120919 - RNA, 1401 nt, Artificial Sequence
  derived and/or modified sequence opt2 from neuraminidase__InfluenzaB__AGX19374
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccucuccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120920 - RNA, 1401 nt, Artificial Sequence; identical to SEQ ID NO: 120912
  derived and/or modified sequence opt2 from neuraminidase__InfluenzaB__AGX19385

SEQ ID NO: 120921 - RNA, 1401 nt, Artificial Sequence
  derived and/or modified sequence opt2 from neuraminidase__InfluenzaB__AGX19396
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcccccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120922 - RNA, 1401 nt, Artificial Sequence; identical to SEQ ID NO: 120912
  derived and/or modified sequence opt2 from neuraminidase__InfluenzaB__AGX19407

SEQ ID NO: 120923 - RNA, 1401 nt, Artificial Sequence; identical to SEQ ID NO: 120473
  derived and/or modified sequence opt2 from neuraminidase__InfluenzaB__AGX19418

SEQ ID NO: 120924 - RNA, 1401 nt, Artificial Sequence
  derived and/or modified sequence opt2 from neuraminidase__InfluenzaB__AGX19429
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 120925 - RNA, 1401 nt, Artificial Sequence
  derived and/or modified sequence opt2 from neuraminidase__InfluenzaB__AGX19451
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120926 - RNA, 1401 nt, Artificial Sequence; identical to SEQ ID NO: 120924
  derived and/or modified sequence opt2 from neuraminidase__InfluenzaB__AGX19462

SEQ ID NO: 120927 - RNA, 1401 nt, Artificial Sequence; identical to SEQ ID NO: 120924
  derived and/or modified sequence opt2 from neuraminidase__InfluenzaB__AGX19473

SEQ ID NO: 120928 - RNA, 1401 nt, Artificial Sequence; identical to SEQ ID NO: 120473
  derived and/or modified sequence opt2 from neuraminidase__InfluenzaB__AGX19484

SEQ ID NO: 120929 - RNA, 1401 nt, Artificial Sequence; identical to SEQ ID NO: 120925
  derived and/or modified sequence opt2 from neuraminidase__InfluenzaB__AGX19495

SEQ ID NO: 120930 - RNA, 1401 nt, Artificial Sequence; identical to SEQ ID NO: 120473
  derived and/or modified sequence opt2 from neuraminidase__InfluenzaB__AGX19506

SEQ ID NO: 120931 - RNA, 1401 nt, Artificial Sequence; identical to SEQ ID NO: 120473
  derived and/or modified sequence opt2 from neuraminidase__InfluenzaB__AGX19517

SEQ ID NO: 120932 - RNA, 1401 nt, Artificial Sequence; identical to SEQ ID NO: 120473
  derived and/or modified sequence opt2 from neuraminidase__InfluenzaB__AGX19528

SEQ ID NO: 120933 - RNA, 1401 nt, Artificial Sequence; identical to SEQ ID NO: 120925
  derived and/or modified sequence opt2 from neuraminidase__InfluenzaB__AGX19539

SEQ ID NO: 120934 - RNA, 1401 nt, Artificial Sequence
  derived and/or modified sequence opt2 from neuraminidase__InfluenzaB__AGX19550
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaacgagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120935 - RNA, 1401 nt, Artificial Sequence
  derived and/or modified sequence opt2 from neuraminidase__InfluenzaB__AGX19561
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagccccgcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120936 - RNA, 1401 nt, Artificial Sequence
  derived and/or modified sequence opt2 from neuraminidase__InfluenzaB__AGX19572
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120937 - RNA, 1401 nt, Artificial Sequence; identical to SEQ ID NO: 120473
  derived and/or modified sequence opt2 from neuraminidase__InfluenzaB__AGX19583

SEQ ID NO: 120938 - RNA, 1401 nt, Artificial Sequence; identical to SEQ ID NO: 120473
  derived and/or modified sequence opt2 from neuraminidase__InfluenzaB__AGX19594

SEQ ID NO: 120939 - RNA, 1401 nt, Artificial Sequence; identical to SEQ ID NO: 120473
  derived and/or modified sequence opt2 from neuraminidase__InfluenzaB__AGX19605

SEQ ID NO: 120940 - RNA, 1401 nt, Artificial Sequence; identical to SEQ ID NO: 120473
  derived and/or modified sequence opt2 from neuraminidase__InfluenzaB__AGX19616

SEQ ID NO: 120941 - RNA, 1401 nt, Artificial Sequence; identical to SEQ ID NO: 120925
  derived and/or modified sequence opt2 from neuraminidase__InfluenzaB__AGX19627

SEQ ID NO: 120942 - RNA, 1401 nt, Artificial Sequence; identical to SEQ ID NO: 120473
  derived and/or modified sequence opt2 from neuraminidase__InfluenzaB__AGX19638

SEQ ID NO: 120943 - RNA, 1401 nt, Artificial Sequence; identical to SEQ ID NO: 120925
  derived and/or modified sequence opt2 from neuraminidase__InfluenzaB__AGX19649

SEQ ID NO: 120944 - RNA, 1401 nt, Artificial Sequence; identical to SEQ ID NO: 120925
  derived and/or modified sequence opt2 from neuraminidase__InfluenzaB__AGX19660

SEQ ID NO: 120945 - RNA, 1401 nt, Artificial Sequence; identical to SEQ ID NO: 120473
  derived and/or modified sequence opt2 from neuraminidase__InfluenzaB__AGX19671

SEQ ID NO: 120946 - RNA, 1401 nt, Artificial Sequence; identical to SEQ ID NO: 120473
  derived and/or modified sequence opt2 from neuraminidase__InfluenzaB__AGX19682

SEQ ID NO: 120947 - RNA, 1401 nt, Artificial Sequence; identical to SEQ ID NO: 120925
  derived and/or modified sequence opt2 from neuraminidase__InfluenzaB__AGX19704

SEQ ID NO: 120948 - RNA, 1401 nt, Artificial Sequence
  derived and/or modified sequence opt2 from neuraminidase__InfluenzaB__AGX19715
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccaccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120949 - RNA, 1401 nt, Artificial Sequence; identical to SEQ ID NO: 120473
  derived and/or modified sequence opt2 from neuraminidase__InfluenzaB__AGX19726

SEQ ID NO: 120950 - RNA, 1401 nt, Artificial Sequence; identical to SEQ ID NO: 120473
  derived and/or modified sequence opt2 from neuraminidase__InfluenzaB__AGX19737

SEQ ID NO: 120951 - RNA, 1401 nt, Artificial Sequence; identical to SEQ ID NO: 120473
  derived and/or modified sequence opt2 from neuraminidase__InfluenzaB__AGX19748

SEQ ID NO: 120952 - RNA, 1401 nt, Artificial Sequence; identical to SEQ ID NO: 120925
  derived and/or modified sequence opt2 from neuraminidase__InfluenzaB__AGX19759

SEQ ID NO: 120953 - RNA, 1401 nt, Artificial Sequence; identical to SEQ ID NO: 120473
  derived and/or modified sequence opt2 from neuraminidase__InfluenzaB__AGX19770

SEQ ID NO: 120954 - RNA, 1401 nt, Artificial Sequence; identical to SEQ ID NO: 120473
  derived and/or modified sequence opt2 from neuraminidase__InfluenzaB__AGX19781

SEQ ID NO: 120955 - RNA, 1401 nt, Artificial Sequence; identical to SEQ ID NO: 120473
  derived and/or modified sequence opt2 from neuraminidase__InfluenzaB__AGX19792

SEQ ID NO: 120956 - RNA, 1401 nt, Artificial Sequence; identical to SEQ ID NO: 120473
  derived and/or modified sequence opt2 from neuraminidase__InfluenzaB__AGX19803

SEQ ID NO: 120957 - RNA, 1401 nt, Artificial Sequence; identical to SEQ ID NO: 120473
  derived and/or modified sequence opt2 from neuraminidase__InfluenzaB__AGX19814

SEQ ID NO: 120958 - RNA, 1401 nt, Artificial Sequence
  derived and/or modified sequence opt2 from neuraminidase__InfluenzaB__AGX19825
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccaacaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120959 - RNA, 1401 nt, Artificial Sequence; identical to SEQ ID NO: 120473
  derived and/or modified sequence opt2 from neuraminidase__InfluenzaB__AGX19836

SEQ ID NO: 120960 - RNA, 1401 nt, Artificial Sequence; identical to SEQ ID NO: 120473
  derived and/or modified sequence opt2 from neuraminidase__InfluenzaB__AGX19847

SEQ ID NO: 120961 - RNA, 1401 nt, Artificial Sequence; identical to SEQ ID NO: 120473
  derived and/or modified sequence opt2 from neuraminidase__InfluenzaB__AGX19858

SEQ ID NO: 120962 - RNA, 1401 nt, Artificial Sequence; identical to SEQ ID NO: 120473
  derived and/or modified sequence opt2 from neuraminidase__InfluenzaB__AGX19869

SEQ ID NO: 120963 - RNA, 1401 nt, Artificial Sequence; identical to SEQ ID NO: 120473
  derived and/or modified sequence opt2 from neuraminidase__InfluenzaB__AGX19880

SEQ ID NO: 120964 - RNA, 1401 nt, Artificial Sequence; identical to SEQ ID NO: 120473
  derived and/or modified sequence opt2 from neuraminidase__InfluenzaB__AGX19891

SEQ ID NO: 120965 - RNA, 1401 nt, Artificial Sequence; identical to SEQ ID NO: 120473
  derived and/or modified sequence opt2 from neuraminidase__InfluenzaB__AGX19902

SEQ ID NO: 120966 - RNA, 1401 nt, Artificial Sequence
  derived and/or modified sequence opt2 from neuraminidase__InfluenzaB__AGX19913
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccaugaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120967 - RNA, 1401 nt, Artificial Sequence; identical to SEQ ID NO: 120473
  derived and/or modified sequence opt2 from neuraminidase__InfluenzaB__AGX19924

SEQ ID NO: 120968 - RNA, 1401 nt, Artificial Sequence; identical to SEQ ID NO: 120473
  derived and/or modified sequence opt2 from neuraminidase__InfluenzaB__AGX19935

SEQ ID NO: 120969 - RNA, 1401 nt, Artificial Sequence; identical to SEQ ID NO: 120473
  derived and/or modified sequence opt2 from neuraminidase__InfluenzaB__AGX19946

SEQ ID NO: 120970 - RNA, 1401 nt, Artificial Sequence; identical to SEQ ID NO: 120473
  derived and/or modified sequence opt2 from neuraminidase__InfluenzaB__AGX19957

SEQ ID NO: 120971 - RNA, 1401 nt, Artificial Sequence
  derived and/or modified sequence opt2 from neuraminidase__InfluenzaB__AGX19968
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120972 - RNA, 1401 nt, Artificial Sequence; identical to SEQ ID NO: 120925
  derived and/or modified sequence opt2 from neuraminidase__InfluenzaB__AGX19979

SEQ ID NO: 120973 - RNA, 1401 nt, Artificial Sequence; identical to SEQ ID NO: 120925
  derived and/or modified sequence opt2 from neuraminidase__InfluenzaB__AGX19990

SEQ ID NO: 120974 - RNA, 1401 nt, Artificial Sequence; identical to SEQ ID NO: 120473
  derived and/or modified sequence opt2 from neuraminidase__InfluenzaB__AGX20001

SEQ ID NO: 120975 - RNA, 1401 nt, Artificial Sequence; identical to SEQ ID NO: 120473
  derived and/or modified sequence opt2 from neuraminidase__InfluenzaB__AGX20012

SEQ ID NO: 120976 - RNA, 1401 nt, Artificial Sequence; identical to SEQ ID NO: 120473
  derived and/or modified sequence opt2 from neuraminidase__InfluenzaB__AGX20023

SEQ ID NO: 120977 - RNA, 1401 nt, Artificial Sequence; identical to SEQ ID NO: 120473
  derived and/or modified sequence opt2 from neuraminidase__InfluenzaB__AGX20034

SEQ ID NO: 120978 - RNA, 1401 nt, Artificial Sequence; identical to SEQ ID NO: 120473
  derived and/or modified sequence opt2 from neuraminidase__InfluenzaB__AGX20045

SEQ ID NO: 120979 - RNA, 1401 nt, Artificial Sequence
  derived and/or modified sequence opt2 from neuraminidase__InfluenzaB__AGX20056
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaugauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120980 - RNA, 1401 nt, Artificial Sequence
  derived and/or modified sequence opt2 from neuraminidase__InfluenzaB__AGX20067
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120981 - RNA, 1401 nt, Artificial Sequence; identical to SEQ ID NO: 120473
  derived and/or modified sequence opt2 from neuraminidase__InfluenzaB__AGX20078

SEQ ID NO: 120982 - RNA, 1401 nt, Artificial Sequence; identical to SEQ ID NO: 120473
  derived and/or modified sequence opt2 from neuraminidase__InfluenzaB__AGX20089

SEQ ID NO: 120983 - RNA, 1401 nt, Artificial Sequence
  derived and/or modified sequence opt2 from neuraminidase__InfluenzaB__AGX20100
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgccguccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcauccagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 120984 - RNA, 1401 nt, Artificial Sequence
  derived and/or modified sequence opt2 from neuraminidase__InfluenzaB__AGX20111
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120985 - RNA, 1401 nt, Artificial Sequence
  derived and/or modified sequence opt2 from neuraminidase__InfluenzaB__AGX20122
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120986 - RNA, 1401 nt, Artificial Sequence
  derived and/or modified sequence opt2 from neuraminidase__InfluenzaB__AGX20133
augcuccccuccaccauccagacccucacccucuuccucaccuccggcggcguccuccucucccucuacgucuccgcccuccucuccuaccuccucuacuccgacguccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120987 - RNA, 1401 nt, Artificial Sequence
  derived and/or modified sequence opt2 from neuraminidase__InfluenzaB__AGX20144
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120988 - RNA, 1401 nt, Artificial Sequence; identical to SEQ ID NO: 120987
  derived and/or modified sequence opt2 from neuraminidase__InfluenzaB__AGX20155

SEQ ID NO: 120989 - RNA, 1401 nt, Artificial Sequence; identical to SEQ ID NO: 120987
  derived and/or modified sequence opt2 from neuraminidase__InfluenzaB__AGX20166

SEQ ID NO: 120990 - RNA, 1401 nt, Artificial Sequence; identical to SEQ ID NO: 120407
  derived and/or modified sequence opt2 from neuraminidase__InfluenzaB__AGX20177

SEQ ID NO: 120991 - RNA, 1401 nt, Artificial Sequence; identical to SEQ ID NO: 120407
  derived and/or modified sequence opt2 from neuraminidase__InfluenzaB__AGX20188

SEQ ID NO: 120992 - RNA, 1401 nt, Artificial Sequence; identical to SEQ ID NO: 120384
  derived and/or modified sequence opt2 from neuraminidase__InfluenzaB__AGX20199

SEQ ID NO: 120993 - RNA, 1401 nt, Artificial Sequence; identical to SEQ ID NO: 120407
  derived and/or modified sequence opt2 from neuraminidase__InfluenzaB__AGX20210

SEQ ID NO: 120994 - RNA, 1401 nt, Artificial Sequence; identical to SEQ ID NO: 120987
  derived and/or modified sequence opt2 from neuraminidase__InfluenzaB__AGX20221

SEQ ID NO: 120995 - RNA, 1401 nt, Artificial Sequence
  derived and/or modified sequence opt2 from neuraminidase__InfluenzaB__AGX20232
augcuccccuccaccauccagacccucacccucuuccucaccuccggcggcguccuccucucccucuacgucuccgccucccucuccuaccuccucuacuccggcauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacgagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcggcggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 120996 - RNA, 1401 nt, Artificial Sequence; identical to SEQ ID NO: 120407
  derived and/or modified sequence opt2 from neuraminidase__InfluenzaB__AGX20243

SEQ ID NO: 120997 - RNA, 1401 nt, Artificial Sequence; identical to SEQ ID NO: 120987
  derived and/or modified sequence opt2 from neuraminidase__InfluenzaB__AGX20254

SEQ ID NO: 120998 - RNA, 1401 nt, Artificial Sequence; identical to SEQ ID NO: 120384
  derived and/or modified sequence opt2 from neuraminidase__InfluenzaB__AGX20265

SEQ ID NO: 120999 - RNA, 1401 nt, Artificial Sequence; identical to SEQ ID NO: 120987
  derived and/or modified sequence opt2 from neuraminidase__InfluenzaB__AGX20276

SEQ ID NO: 121000 - RNA, 1401 nt, Artificial Sequence; identical to SEQ ID NO: 120407
  derived and/or modified sequence opt2 from neuraminidase__InfluenzaB__AGX20287

SEQ ID NO: 121001 - RNA, 1401 nt, Artificial Sequence
  derived and/or modified sequence opt2 from neuraminidase__InfluenzaB__AGX20298
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcaguccgccgccaccgccaucuacugccucaugggcuccggccagcuccucugggacaccgucaccggcgucgacauggcccucuga

SEQ ID NO: 121002 - RNA, 1401 nt, Artificial Sequence; identical to SEQ ID NO: 120384
  derived and/or modified sequence opt2 from neuraminidase__InfluenzaB__AGX20320

SEQ ID NO: 121003 - RNA, 1401 nt, Artificial Sequence; identical to SEQ ID NO: 120407
  derived and/or modified sequence opt2 from neuraminidase__InfluenzaB__AGX20331

SEQ ID NO: 121004 - RNA, 1401 nt, Artificial Sequence
  derived and/or modified sequence opt2 from neuraminidase__InfluenzaB__AGX20342
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121005 - RNA, 1401 nt, Artificial Sequence
  derived and/or modified sequence opt2 from neuraminidase__InfluenzaB__AGX20353
augcuccccuccaccauccagacccucacccucuuccucaccuccggcggcguccuccucucccucuacgucuccgcccuccucuccuaccuccucuacuccgacauccuccucaaguucucccccaccgagaucaucgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaaccgcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121006 - RNA, 1401 nt, Artificial Sequence; identical to SEQ ID NO: 120407
  derived and/or modified sequence opt2 from neuraminidase__InfluenzaB__AGX20364

SEQ ID NO: 121007 - RNA, 1401 nt, Artificial Sequence; identical to SEQ ID NO: 120402
  derived and/or modified sequence opt2 from neuraminidase__InfluenzaB__AGX20375

SEQ ID NO: 121008 - RNA, 1401 nt, Artificial Sequence
  derived and/or modified sequence opt2 from neuraminidase__InfluenzaB__AGX20386
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggacccacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121009 - RNA, 1401 nt, Artificial Sequence; identical to SEQ ID NO: 120407
  derived and/or modified sequence opt2 from neuraminidase__InfluenzaB__AGX20397

SEQ ID NO: 121010 - RNA, 1401 nt, Artificial Sequence; identical to SEQ ID NO: 120402
  derived and/or modified sequence opt2 from neuraminidase__InfluenzaB__AGX20408

SEQ ID NO: 121011 - RNA, 1401 nt, Artificial Sequence; identical to SEQ ID NO: 120384
  derived and/or modified sequence opt2 from neuraminidase__InfluenzaB__AGX20419

SEQ ID NO: 121012 - RNA, 1401 nt, Artificial Sequence
  derived and/or modified sequence opt2 from neuraminidase__InfluenzaB__AGX20430
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgaggccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121013 - RNA, 1401 nt, Artificial Sequence; identical to SEQ ID NO: 120384
  derived and/or modified sequence opt2 from neuraminidase__InfluenzaB__AGX20441

SEQ ID NO: 121014 - RNA, 1401 nt, Artificial Sequence
  derived and/or modified sequence opt2 from neuraminidase__InfluenzaB__AGX20452
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagauccgcgacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121015 - RNA, 1401 nt, Artificial Sequence; identical to SEQ ID NO: 120407
  derived and/or modified sequence opt2 from neuraminidase__InfluenzaB__AGX20463

SEQ ID NO: 121016 - RNA, 1401 nt, Artificial Sequence; identical to SEQ ID NO: 120407
  derived and/or modified sequence opt2 from neuraminidase__InfluenzaB__AGX20474

SEQ ID NO: 121017 - RNA, 1401 nt, Artificial Sequence; identical to SEQ ID NO: 120407
  derived and/or modified sequence opt2 from neuraminidase__InfluenzaB__AGX20485

SEQ ID NO: 121018 - RNA, 1401 nt, Artificial Sequence; identical to SEQ ID NO: 120987
  derived and/or modified sequence opt2 from neuraminidase__InfluenzaB__AGX20496

SEQ ID NO: 121019 - RNA, 1401 nt, Artificial Sequence; identical to SEQ ID NO: 120407
  derived and/or modified sequence opt2 from neuraminidase__InfluenzaB__AGX20507

SEQ ID NO: 121020 - RNA, 1401 nt, Artificial Sequence; identical to SEQ ID NO: 120407
  derived and/or modified sequence opt2 from neuraminidase__InfluenzaB__AGX20518

SEQ ID NO: 121021 - RNA, 1401 nt, Artificial Sequence
  derived and/or modified sequence opt2 from neuraminidase__InfluenzaB__AGX20529
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcaccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121022 - RNA, 1401 nt, Artificial Sequence; identical to SEQ ID NO: 120985
  derived and/or modified sequence opt2 from neuraminidase__InfluenzaB__AGX20540

SEQ ID NO: 121023 - RNA, 1401 nt, Artificial Sequence; identical to SEQ ID NO: 120631
  derived and/or modified sequence opt2 from neuraminidase__InfluenzaB__AGX20551

SEQ ID NO: 121024 - RNA, 1401 nt, Artificial Sequence; identical to SEQ ID NO: 120384
  derived and/or modified sequence opt2 from neuraminidase__InfluenzaB__AGX20562

SEQ ID NO: 121025 - RNA, 1401 nt, Artificial Sequence; identical to SEQ ID NO: 120407
  derived and/or modified sequence opt2 from neuraminidase__InfluenzaB__AGX20573

SEQ ID NO: 121026 - RNA, 1401 nt, Artificial Sequence
  derived and/or modified sequence opt2 from neuraminidase__InfluenzaB__AGX20584
augcuccccuccaccauccagacccucacccucuuccucaccuccggcggcguccuccucucccucuacgucuccgccucccucuccuaccuccucuacuccgacauccuccucaaguucuccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggagucccgcaucggccgcugguacucccgcaccauguccaagaccgagcgcaugggcaugggccucuacgucaaguacgacggcgaccccuggaccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121027 - RNA, 1401 nt, Artificial Sequence; identical to SEQ ID NO: 120407
  derived and/or modified sequence opt2 from neuraminidase__InfluenzaB__AGX20595

SEQ ID NO: 121028 - RNA, 1401 nt, Artificial Sequence; identical to SEQ ID NO: 120985
  derived and/or modified sequence opt2 from neuraminidase__InfluenzaB__AGX20606

SEQ ID NO: 121029 - RNA, 1401 nt, Artificial Sequence; identical to SEQ ID NO: 120985
  derived and/or modified sequence opt2 from neuraminidase__InfluenzaB__AGX20617

SEQ ID NO: 121030 - RNA, 1401 nt, Artificial Sequence; identical to SEQ ID NO: 121012
  derived and/or modified sequence opt2 from neuraminidase__InfluenzaB__AGX20628

SEQ ID NO: 121031 - RNA, 1401 nt, Artificial Sequence; identical to SEQ ID NO: 120412
  derived and/or modified sequence opt2 from neuraminidase__InfluenzaB__AGX20639

SEQ ID NO: 121032 - RNA, 1401 nt, Artificial Sequence
  derived and/or modified sequence opt2 from neuraminidase__InfluenzaB__AGX20650
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccaccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121033 - RNA, 1401 nt, Artificial Sequence
  derived and/or modified sequence opt2 from neuraminidase__InfluenzaB__AGX20661
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaaccucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccuggaccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121034 - RNA, 1401 nt, Artificial Sequence; identical to SEQ ID NO: 120468
  derived and/or modified sequence opt2 from neuraminidase__InfluenzaB__AGX20683

SEQ ID NO: 121035 - RNA, 1401 nt, Artificial Sequence; identical to SEQ ID NO: 120631
  derived and/or modified sequence opt2 from neuraminidase__InfluenzaB__AGX20694

SEQ ID NO: 121036 - RNA, 1401 nt, Artificial Sequence
  derived and/or modified sequence opt2 from neuraminidase__InfluenzaB__AGX20705
augcuccccuccaccauccagacccucacccucuuccucaccuccggcggcguccuccucucccucuacgucuccgccucccucuccuaccuccucuacuccggcauccuccucaaguucucccccaccgagaucaccgcccccaccaugccccucgacugcgccaacgccuccgacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121037 - RNA, 1401 nt, Artificial Sequence
  derived and/or modified sequence opt2 from neuraminidase__InfluenzaB__AGX20716
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaucgagucccgcaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121038 - RNA, 1401 nt, Artificial Sequence
  derived and/or modified sequence opt2 from neuraminidase__InfluenzaB__AGX20727
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaccaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121039 - RNA, 1401 nt, Artificial Sequence; identical to SEQ ID NO: 120631
  derived and/or modified sequence opt2 from neuraminidase__InfluenzaB__AGX20738

SEQ ID NO: 121040 - RNA, 1401 nt, Artificial Sequence; identical to SEQ ID NO: 120407
  derived and/or modified sequence opt2 from neuraminidase__InfluenzaB__AGX20749

SEQ ID NO: 121041 - RNA, 1401 nt, Artificial Sequence
  derived and/or modified sequence opt2 from neuraminidase__InfluenzaB__AGX20760
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggagucccgcaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121042 - RNA, 1401 nt, Artificial Sequence; identical to SEQ ID NO: 120407
  derived and/or modified sequence opt2 from neuraminidase__InfluenzaB__AGX20771

SEQ ID NO: 121043 - RNA, 1401 nt, Artificial Sequence
  derived and/or modified sequence opt2 from neuraminidase__InfluenzaB__AGX20782
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccucccaccgcuucggcgagaccaagggcaacuccgccccccucaucauccgcgagcccuucgucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccaugucccgcaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121044 - RNA, 1401 nt, Artificial Sequence
  derived and/or modified sequence opt2 from neuraminidase__InfluenzaB__AGX20793
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacaccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121045 - RNA, 1401 nt, Artificial Sequence
  derived and/or modified sequence opt2 from neuraminidase__InfluenzaB__AGX20804
augcuccccuccaccauccagacccucacccucuucaucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121046 - RNA, 1401 nt, Artificial Sequence; identical to SEQ ID NO: 120468
  derived and/or modified sequence opt2 from neuraminidase__InfluenzaB__AGX20815

SEQ ID NO: 121047 - RNA, 1401 nt, Artificial Sequence; identical to SEQ ID NO: 120468
  derived and/or modified sequence opt2 from neuraminidase__InfluenzaB__AGX20826

SEQ ID NO: 121048 - RNA, 1401 nt, Artificial Sequence; identical to SEQ ID NO: 120468
  derived and/or modified sequence opt2 from neuraminidase__InfluenzaB__AGX20837

SEQ ID NO: 121049 - RNA, 1401 nt, Artificial Sequence; identical to SEQ ID NO: 120468
  derived and/or modified sequence opt2 from neuraminidase__InfluenzaB__AGX20848

SEQ ID NO: 121050 - RNA, 1401 nt, Artificial Sequence
  derived and/or modified sequence opt2 from neuraminidase__InfluenzaB__AGX20870
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgagcccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121051 - RNA, 1401 nt, Artificial Sequence
  derived and/or modified sequence opt2 from neuraminidase__InfluenzaB__AGX20881
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcaaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121052 - RNA, 1401 nt, Artificial Sequence
  derived and/or modified sequence opt2 from neuraminidase__InfluenzaB__AGX20892
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgaggccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagauccuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121053 - RNA, 1401 nt, Artificial Sequence; identical to SEQ ID NO: 120468
  derived and/or modified sequence opt2 from neuraminidase__InfluenzaB__AGX20903

SEQ ID NO: 121054 - RNA, 1401 nt, Artificial Sequence; identical to SEQ ID NO: 120468
  derived and/or modified sequence opt2 from neuraminidase__InfluenzaB__AGX20914

SEQ ID NO: 121055 - RNA, 1401 nt, Artificial Sequence
  derived and/or modified sequence opt2 from neuraminidase__InfluenzaB__AGX20925
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccaggagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121056 - RNA, 1401 nt, Artificial Sequence
  derived and/or modified sequence opt2 from neuraminidase__InfluenzaB__AGX20936
augcuccccuccaccauccagacccucacccucuuccucaccuccggcggcguccuccucucccucuacgucuccgcccuccucuccuaccuccucuacuccgacauccuccccaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121057 - RNA, 1401 nt, Artificial Sequence; identical to SEQ ID NO: 120407
  derived and/or modified sequence opt2 from neuraminidase__InfluenzaB__AGX20947

SEQ ID NO: 121058 - RNA, 1401 nt, Artificial Sequence
  derived and/or modified sequence opt2 from neuraminidase__InfluenzaB__AGX20958
augcuccccuccaccauccagacccucacccucuuccucaccuccggcggcguccuccucucccucuacgucuccgcccuccucuccuaccuccucuacuccgacauccuccucaaguucucccccaccgagaucaccacccccaccaugucccucgacugcaccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccaggagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121059 - RNA, 1401 nt, Artificial Sequence; identical to SEQ ID NO: 120631
  derived and/or modified sequence opt2 from neuraminidase__InfluenzaB__AGX20969

SEQ ID NO: 121060 - RNA, 1401 nt, Artificial Sequence; identical to SEQ ID NO: 121044
  derived and/or modified sequence opt2 from neuraminidase__InfluenzaB__AGX20980

SEQ ID NO: 121061 - RNA, 1401 nt, Artificial Sequence
  derived and/or modified sequence opt2 from neuraminidase__InfluenzaB__AGX20991
augcuccccuccaccauccagacccucacccucuuccucaccuccggcggcguccuccucucccucuacgucuccgcccuccucuccuaccuccucuacuccgacauccuccccaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcaagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121062 - RNA, 1401 nt, Artificial Sequence; identical to SEQ ID NO: 120468
  derived and/or modified sequence opt2 from neuraminidase__InfluenzaB__AGX21002

SEQ ID NO: 121063 - RNA, 1401 nt, Artificial Sequence
  derived and/or modified sequence opt2 from neuraminidase__InfluenzaB__AGX21013
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121064 - RNA, 1401 nt, Artificial Sequence
  derived and/or modified sequence opt2 from neuraminidase__InfluenzaB__AGX21024
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucucccccaaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagguccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121065 - RNA, 1401 nt, Artificial Sequence; identical to SEQ ID NO: 120468
  derived and/or modified sequence opt2 from neuraminidase__InfluenzaB__AGX21035

SEQ ID NO: 121066 - RNA, 1401 nt, Artificial Sequence; identical to SEQ ID NO: 120631
  derived and/or modified sequence opt2 from neuraminidase__InfluenzaB__AGX21046

SEQ ID NO: 121067 - RNA, 1401 nt, Artificial Sequence; identical to SEQ ID NO: 120634
  derived and/or modified sequence opt2 from neuraminidase__InfluenzaB__AGX21057

SEQ ID NO: 121068 - RNA, 1401 nt, Artificial Sequence; identical to SEQ ID NO: 121052
  derived and/or modified sequence opt2 from neuraminidase__InfluenzaB__AGX21068

SEQ ID NO: 121069 - RNA, 1401 nt, Artificial Sequence
  derived and/or modified sequence opt2 from neuraminidase__InfluenzaB__AGX21079
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccuccaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121070 - RNA, 1401 nt, Artificial Sequence; identical to SEQ ID NO: 120634
  derived and/or modified sequence opt2 from neuraminidase__InfluenzaB__AGX21088

SEQ ID NO: 121071 - RNA, 1401 nt, Artificial Sequence; identical to SEQ ID NO: 120634
  derived and/or modified sequence opt2 from neuraminidase__InfluenzaB__AGX21099

SEQ ID NO: 121072 - RNA, 1401 nt, Artificial Sequence
  derived and/or modified sequence opt2 from neuraminidase__InfluenzaB__AGX21110
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuucgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121073 - RNA, 1401 nt, Artificial Sequence
  derived and/or modified sequence opt2 from neuraminidase__InfluenzaB__AGX21121
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaccaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121074 - RNA, 1401 nt, Artificial Sequence; identical to SEQ ID NO: 120631
  derived and/or modified sequence opt2 from neuraminidase__InfluenzaB__AGX21132

SEQ ID NO: 121075 - RNA, 1401 nt, Artificial Sequence; identical to SEQ ID NO: 120407
  derived and/or modified sequence opt2 from neuraminidase__InfluenzaB__AGX21143

SEQ ID NO: 121076 - RNA, 1401 nt, Artificial Sequence; identical to SEQ ID NO: 120468
  derived and/or modified sequence opt2 from neuraminidase__InfluenzaB__AGX21154

SEQ ID NO: 121077 - RNA, 1401 nt, Artificial Sequence
  derived and/or modified sequence opt2 from neuraminidase__InfluenzaB__AGX21165
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacauggagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121078 - RNA, 1401 nt, Artificial Sequence; identical to SEQ ID NO: 120468
  derived and/or modified sequence opt2 from neuraminidase__InfluenzaB__AGX21176

SEQ ID NO: 121079 - RNA, 1401 nt, Artificial Sequence
  derived and/or modified sequence opt2 from neuraminidase__InfluenzaB__AGX21187
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgucugccgcgacaacuccuacaccgccaagcgccccuucgucaagcucaacgucgagaccgacaccgccgagguccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121080 - RNA, 1401 nt, Artificial Sequence
  derived and/or modified sequence opt2 from neuraminidase__InfluenzaB__AGX21198
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcgagcccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121081 - RNA, 1401 nt, Artificial Sequence; identical to SEQ ID NO: 120468
  derived and/or modified sequence opt2 from neuraminidase__InfluenzaB__AGX21209

SEQ ID NO: 121082 - RNA, 1401 nt, Artificial Sequence; identical to SEQ ID NO: 120631
  derived and/or modified sequence opt2 from neuraminidase__InfluenzaB__AGX21220

SEQ ID NO: 121083 - RNA, 1401 nt, Artificial Sequence
  derived and/or modified sequence opt2 from neuraminidase__InfluenzaB__AGX21231
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgaguccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121084 - RNA, 1401 nt, Artificial Sequence; identical to SEQ ID NO: 120634
  derived and/or modified sequence opt2 from neuraminidase__InfluenzaB__AGX21242

SEQ ID NO: 121085 - RNA, 1401 nt, Artificial Sequence; identical to SEQ ID NO: 120468
  derived and/or modified sequence opt2 from neuraminidase__InfluenzaB__AGX21253

SEQ ID NO: 121086 - RNA, 1401 nt, Artificial Sequence
  derived and/or modified sequence opt2 from neuraminidase__InfluenzaB__AGX21264
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaacaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccuccugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121087 - RNA, 1401 nt, Artificial Sequence; identical to SEQ ID NO: 120407
  derived and/or modified sequence opt2 from neuraminidase__InfluenzaB__AGX21275

SEQ ID NO: 121088 - RNA, 1401 nt, Artificial Sequence; identical to SEQ ID NO: 120468
  derived and/or modified sequence opt2 from neuraminidase__InfluenzaB__AGX21286

SEQ ID NO: 121089 - RNA, 1401 nt, Artificial Sequence
  derived and/or modified sequence opt2 from neuraminidase__InfluenzaB__AGX21297
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgacuggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagguccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121090 - RNA, 1401 nt, Artificial Sequence
  derived and/or modified sequence opt2 from neuraminidase__InfluenzaB__AGX21308
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgcccuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121091 - RNA, 1401 nt, Artificial Sequence; identical to SEQ ID NO: 120412
  derived and/or modified sequence opt2 from neuraminidase__InfluenzaB__AGX21319

SEQ ID NO: 121092 - RNA, 1401 nt, Artificial Sequence; identical to SEQ ID NO: 120407
  derived and/or modified sequence opt2 from neuraminidase__InfluenzaB__AGX21330

SEQ ID NO: 121093 - RNA, 1401 nt, Artificial Sequence; identical to SEQ ID NO: 120407
  derived and/or modified sequence opt2 from neuraminidase__InfluenzaB__AGX21341

SEQ ID NO: 121094 - RNA, 1401 nt, Artificial Sequence; identical to SEQ ID NO: 120634
  derived and/or modified sequence opt2 from neuraminidase__InfluenzaB__AGX21352

SEQ ID NO: 121095 - RNA, 1401 nt, Artificial Sequence
  derived and/or modified sequence opt2 from neuraminidase__InfluenzaB__AGX21363
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccucccaccgcuucggcgagaccaagggcaacuccgccccccucaucauccgcgagcccuucgucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121096 - RNA, 1401 nt, Artificial Sequence; identical to SEQ ID NO: 120407
  derived and/or modified sequence opt2 from neuraminidase__InfluenzaB__AGX21374

SEQ ID NO: 121097 - RNA, 1401 nt, Artificial Sequence; identical to SEQ ID NO: 120468
  derived and/or modified sequence opt2 from neuraminidase__InfluenzaB__AGX21385

SEQ ID NO: 121098 - RNA, 1401 nt, Artificial Sequence; identical to SEQ ID NO: 120468
  derived and/or modified sequence opt2 from neuraminidase__InfluenzaB__AGX21396

SEQ ID NO: 121099 - RNA, 1401 nt, Artificial Sequence; identical to SEQ ID NO: 120407
  derived and/or modified sequence opt2 from neuraminidase__InfluenzaB__AGX21407

SEQ ID NO: 121100 - RNA, 1401 nt, Artificial Sequence; identical to SEQ ID NO: 120407
  derived and/or modified sequence opt2 from neuraminidase__InfluenzaB__AGX21418

SEQ ID NO: 121101 - RNA, 1401 nt, Artificial Sequence
  derived and/or modified sequence opt2 from neuraminidase__InfluenzaB__AGX21429
augcuccccuccaccauccagacccucacccucuuccucaccuccggcggcguccuccucucccucuacgucuccgcccuccucuccuaccuccuccacuccgacauccuccucaaguucucccccaccgagaucaccgcccccaccaugucccucgacugcgccaacgccuccaacguccaggccgucaaccgcuccgucaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121102 - RNA, 1401 nt, Artificial Sequence; identical to SEQ ID NO: 120468
  derived and/or modified sequence opt2 from neuraminidase__InfluenzaB__AGX21440

SEQ ID NO: 121103 - RNA, 1401 nt, Artificial Sequence; identical to SEQ ID NO: 120468
  derived and/or modified sequence opt2 from neuraminidase__InfluenzaB__AGX21451

SEQ ID NO: 121104 - RNA, 1401 nt, Artificial Sequence; identical to SEQ ID NO: 121052
  derived and/or modified sequence opt2 from neuraminidase__InfluenzaB__AGX21462

SEQ ID NO: 121105 - RNA, 1401 nt, Artificial Sequence
  derived and/or modified sequence opt2 from neuraminidase__InfluenzaB__AGX21473
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgaggccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagauccuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121106 - RNA, 1401 nt, Artificial Sequence; identical to SEQ ID NO: 120412
  derived and/or modified sequence opt2 from neuraminidase__InfluenzaB__AGX21484

SEQ ID NO: 121107 - RNA, 1401 nt, Artificial Sequence; identical to SEQ ID NO: 120468
  derived and/or modified sequence opt2 from neuraminidase__InfluenzaB__AGX21495

SEQ ID NO: 121108 - RNA, 1401 nt, Artificial Sequence; identical to SEQ ID NO: 120468
  derived and/or modified sequence opt2 from neuraminidase__InfluenzaB__AGX21506

SEQ ID NO: 121109 - RNA, 1401 nt, Artificial Sequence
  derived and/or modified sequence opt2 from neuraminidase__InfluenzaB__AGX21517
augcuccccuccaccauccagacccucacccucuuccucaccuccggcggcguccuccucucccucuacgucuccgcccuccucuccuaccuccucuacuccaacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121110 - RNA, 1401 nt, Artificial Sequence
  derived and/or modified sequence opt2 from neuraminidase__InfluenzaB__AGX21528
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagguccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacuccggcaaggagaccuggcacuccgccgccaccgccaucuacugccucaugggcuccggccagcuccucugggacaccgucaccggcgucgacauggcccucuga

SEQ ID NO: 121111 - RNA, 1401 nt, Artificial Sequence; identical to SEQ ID NO: 120468
  derived and/or modified sequence opt2 from neuraminidase__InfluenzaB__AGX21539

SEQ ID NO: 121112 - RNA, 1401 nt, Artificial Sequence
  derived and/or modified sequence opt2 from neuraminidase__InfluenzaB__AGX21550
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccgccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagguccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121113 - RNA, 1401 nt, Artificial Sequence
  derived and/or modified sequence opt2 from neuraminidase__InfluenzaB__AGX21561
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagguccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagguccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121114 - RNA, 1401 nt, Artificial Sequence; identical to SEQ ID NO: 120412
  derived and/or modified sequence opt2 from neuraminidase__InfluenzaB__AGX21572

SEQ ID NO: 121115 - RNA, 1401 nt, Artificial Sequence
  derived and/or modified sequence opt2 from neuraminidase__InfluenzaB__AGX21583
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgaggccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagauccuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcauggagcucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121116 - RNA, 1401 nt, Artificial Sequence; identical to SEQ ID NO: 120412
  derived and/or modified sequence opt2 from neuraminidase__InfluenzaB__AGX21594

SEQ ID NO: 121117 - RNA, 1401 nt, Artificial Sequence; identical to SEQ ID NO: 120634
  derived and/or modified sequence opt2 from neuraminidase__InfluenzaB__AGX21605

SEQ ID NO: 121118 - RNA, 1401 nt, Artificial Sequence
  derived and/or modified sequence opt2 from neuraminidase__InfluenzaB__AGX21615
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaacaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121119 - RNA, 1401 nt, Artificial Sequence; identical to SEQ ID NO: 120468
  derived and/or modified sequence opt2 from neuraminidase__InfluenzaB__AGX21626

SEQ ID NO: 121120 - RNA, 1401 nt, Artificial Sequence; identical to SEQ ID NO: 120468
  derived and/or modified sequence opt2 from neuraminidase__InfluenzaB__AGX21637

SEQ ID NO: 121121 - RNA, 1401 nt, Artificial Sequence; identical to SEQ ID NO: 120468
  derived and/or modified sequence opt2 from neuraminidase__InfluenzaB__AGX21648

SEQ ID NO: 121122 - RNA, 1401 nt, Artificial Sequence
  derived and/or modified sequence opt2 from neuraminidase__InfluenzaB__AGX21659
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucgucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacggcggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121123 - RNA, 1401 nt, Artificial Sequence
  derived and/or modified sequence opt2 from neuraminidase__InfluenzaB__AGX21670
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaccgagaugguccacgacggcggcaaggagaccuggcacuccgccgccaccgccaucuacugccucaugggcuccggccagcuccucugggacaccgucaccggcgucgacauggcccucuga

SEQ ID NO: 121124 - RNA, 1401 nt, Artificial Sequence
  derived and/or modified sequence opt2 from neuraminidase__InfluenzaB__AGX21681
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcaacggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121125 - RNA, 1401 nt, Artificial Sequence; identical to SEQ ID NO: 120407
  derived and/or modified sequence opt2 from neuraminidase__InfluenzaB__AGX21692

SEQ ID NO: 121126 - RNA, 1401 nt, Artificial Sequence; identical to SEQ ID NO: 120634
  derived and/or modified sequence opt2 from neuraminidase__InfluenzaB__AGX21703

SEQ ID NO: 121127 - RNA, 1401 nt, Artificial Sequence
  derived and/or modified sequence opt2 from neuraminidase__InfluenzaB__AGX21714
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggccucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121128 - RNA, 1401 nt, Artificial Sequence
  derived and/or modified sequence opt2 from neuraminidase__InfluenzaB__AGX21725
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagcgcgcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121129 - RNA, 1401 nt, Artificial Sequence
  derived and/or modified sequence opt2 from neuraminidase__InfluenzaB__AGX21747
augcuccccuccaccauccagacccucacccucuuccucaccuccggcggcguccuccucucccucuacgucuccgccucccucuccuaccuccucuacuccgacauccuccucaaggucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121130 - RNA, 1401 nt, Artificial Sequence
  derived and/or modified sequence opt2 from neuraminidase__InfluenzaB__AGX21758
augcuccccuccaccauccagacccucacccucuuccucaccuccggcggcguccuccucucccucuacgucuccgccucccucuccuaccuccucuacuccgacauccuccucaaguucacccccaccgagaucaccguccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121131 - RNA, 1401 nt, Artificial Sequence
  derived and/or modified sequence opt2 from neuraminidase__InfluenzaB__AGX21769
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgccaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121132 - RNA, 1401 nt, Artificial Sequence
  derived and/or modified sequence opt2 from neuraminidase__InfluenzaB__AGX21780
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacaugacccucuga

SEQ ID NO: 121133 - RNA, 1401 nt, Artificial Sequence
  derived and/or modified sequence opt2 from neuraminidase__InfluenzaB__AGX21791
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacuccggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacaacuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaacaagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121134 - RNA, 1401 nt, Artificial Sequence
  derived and/or modified sequence opt2 from neuraminidase__InfluenzaB__AGX21802
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgccaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121135 - RNA, 1401 nt, Artificial Sequence
  derived and/or modified sequence opt2 from neuraminidase__InfluenzaB__AGX21813
augcuccccuccaccauccagacccucacccucuuccucaccuccggcggcguccuccucucccucuacgucuccgccucccucuccuaccuccucuacuccgacauccuccucaaguucucccagaccgagaucaccgcccccaagaugccccucgacugcgccaacgccuccaacguccaggccgccaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121136 - RNA, 1401 nt, Artificial Sequence
  derived and/or modified sequence opt2 from neuraminidase__InfluenzaB__AGX21824
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagaacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121137 - RNA, 1401 nt, Artificial Sequence; identical to SEQ ID NO: 120255
  derived and/or modified sequence opt2 from neuraminidase__InfluenzaB__AGX21835

SEQ ID NO: 121138 - RNA, 1401 nt, Artificial Sequence; identical to SEQ ID NO: 120643
  derived and/or modified sequence opt2 from neuraminidase__InfluenzaB__AGX21846

SEQ ID NO: 121139 - RNA, 1401 nt, Artificial Sequence; identical to SEQ ID NO: 120643
  derived and/or modified sequence opt2 from neuraminidase__InfluenzaB__AGX21857

SEQ ID NO: 121140 - RNA, 1401 nt, Artificial Sequence; identical to SEQ ID NO: 120255
  derived and/or modified sequence opt2 from neuraminidase__InfluenzaB__AGX21868

SEQ ID NO: 121141 - RNA, 1401 nt, Artificial Sequence; identical to SEQ ID NO: 120641
  derived and/or modified sequence opt2 from neuraminidase__InfluenzaB__AGX21879

SEQ ID NO: 121142 - RNA, 1401 nt, Artificial Sequence
  derived and/or modified sequence opt2 from neuraminidase__InfluenzaB__AGX21890
augcuccccuccaccauccagacccucacccucuuccucaccuccggcggcguccuccucucccucuacgucuccgccucccucuccuaccuccucuacuccgacauccuccucaaguucucccagaccgagaucaucgcccccaucaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121143 - RNA, 1401 nt, Artificial Sequence; identical to SEQ ID NO: 120255
  derived and/or modified sequence opt2 from neuraminidase__InfluenzaB__AGX21901

SEQ ID NO: 121144 - RNA, 1401 nt, Artificial Sequence; identical to SEQ ID NO: 120255
  derived and/or modified sequence opt2 from neuraminidase__InfluenzaB__AGX21912

SEQ ID NO: 121145 - RNA, 1401 nt, Artificial Sequence
  derived and/or modified sequence opt2 from neuraminidase__InfluenzaB__AGX21923
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121146 - RNA, 1401 nt, Artificial Sequence; identical to SEQ ID NO: 121142
  derived and/or modified sequence opt2 from neuraminidase__InfluenzaB__AGX21934

SEQ ID NO: 121147 - RNA, 1401 nt, Artificial Sequence; identical to SEQ ID NO: 120643
  derived and/or modified sequence opt2 from neuraminidase__InfluenzaB__AGX21945

SEQ ID NO: 121148 - RNA, 1401 nt, Artificial Sequence
  derived and/or modified sequence opt2 from neuraminidase__InfluenzaB__AGX21956
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacaccuccaacauccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121149 - RNA, 1401 nt, Artificial Sequence; identical to SEQ ID NO: 120643
  derived and/or modified sequence opt2 from neuraminidase__InfluenzaB__AGX21967

SEQ ID NO: 121150 - RNA, 1401 nt, Artificial Sequence; identical to SEQ ID NO: 120255
  derived and/or modified sequence opt2 from neuraminidase__InfluenzaB__AGX21978

SEQ ID NO: 121151 - RNA, 1401 nt, Artificial Sequence; identical to SEQ ID NO: 120643
  derived and/or modified sequence opt2 from neuraminidase__InfluenzaB__AGX21989

SEQ ID NO: 121152 - RNA, 1401 nt, Artificial Sequence; identical to SEQ ID NO: 120641
  derived and/or modified sequence opt2 from neuraminidase__InfluenzaB__AGX22000

SEQ ID NO: 121153 - RNA, 1401 nt, Artificial Sequence
  derived and/or modified sequence opt2 from neuraminidase__InfluenzaB__AGX22011
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgccaagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacaacuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121154 - RNA, 1401 nt, Artificial Sequence; identical to SEQ ID NO: 120255
  derived and/or modified sequence opt2 from neuraminidase__InfluenzaB__AGX22033

SEQ ID NO: 121155 - RNA, 1401 nt, Artificial Sequence; identical to SEQ ID NO: 120255
  derived and/or modified sequence opt2 from neuraminidase__InfluenzaB__AGX22044

SEQ ID NO: 121156 - RNA, 1401 nt, Artificial Sequence; identical to SEQ ID NO: 120641
  derived and/or modified sequence opt2 from neuraminidase__InfluenzaB__AGX22055

SEQ ID NO: 121157 - RNA, 1401 nt, Artificial Sequence; identical to SEQ ID NO: 120255
  derived and/or modified sequence opt2 from neuraminidase__InfluenzaB__AGX22066

SEQ ID NO: 121158 - RNA, 1401 nt, Artificial Sequence; identical to SEQ ID NO: 121142
  derived and/or modified sequence opt2 from neuraminidase__InfluenzaB__AGX22077

SEQ ID NO: 121159 - RNA, 1401 nt, Artificial Sequence; identical to SEQ ID NO: 120257
  derived and/or modified sequence opt2 from neuraminidase__InfluenzaB__AGX22088

SEQ ID NO: 121160 - RNA, 1401 nt, Artificial Sequence; identical to SEQ ID NO: 120643
  derived and/or modified sequence opt2 from neuraminidase__InfluenzaB__AGX22099

SEQ ID NO: 121161 - RNA, 1401 nt, Artificial Sequence; identical to SEQ ID NO: 120641
  derived and/or modified sequence opt2 from neuraminidase__InfluenzaB__AGX22110

SEQ ID NO: 121162 - RNA, 1401 nt, Artificial Sequence; identical to SEQ ID NO: 120643
  derived and/or modified sequence opt2 from neuraminidase__InfluenzaB__AGX22132

SEQ ID NO: 121163 - RNA, 1401 nt, Artificial Sequence
  derived and/or modified sequence opt2 from neuraminidase__InfluenzaB__AGX22143
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccaucuccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121164 - RNA, 1401 nt, Artificial Sequence; identical to SEQ ID NO: 121163
  derived and/or modified sequence opt2 from neuraminidase__InfluenzaB__AGX22154

SEQ ID NO: 121165 - RNA, 1401 nt, Artificial Sequence; identical to SEQ ID NO: 121163
  derived and/or modified sequence opt2 from neuraminidase__InfluenzaB__AGX22165

SEQ ID NO: 121166 - RNA, 1401 nt, Artificial Sequence; identical to SEQ ID NO: 121142
  derived and/or modified sequence opt2 from neuraminidase__InfluenzaB__AGX22176

SEQ ID NO: 121167 - RNA, 1401 nt, Artificial Sequence; identical to SEQ ID NO: 121163
  derived and/or modified sequence opt2 from neuraminidase__InfluenzaB__AGX22187

SEQ ID NO: 121168 - RNA, 1401 nt, Artificial Sequence; identical to SEQ ID NO: 121163
  derived and/or modified sequence opt2 from neuraminidase__InfluenzaB__AGX22198

SEQ ID NO: 121169 - RNA, 1401 nt, Artificial Sequence; identical to SEQ ID NO: 121163
  derived and/or modified sequence opt2 from neuraminidase__InfluenzaB__AGX22209

SEQ ID NO: 121170 - RNA, 1401 nt, Artificial Sequence; identical to SEQ ID NO: 120641
  derived and/or modified sequence opt2 from neuraminidase__InfluenzaB__AGX22220

SEQ ID NO: 121171 - RNA, 1401 nt, Artificial Sequence; identical to SEQ ID NO: 120643
  derived and/or modified sequence opt2 from neuraminidase__InfluenzaB__AGX22231

SEQ ID NO: 121172 - RNA, 1401 nt, Artificial Sequence; identical to SEQ ID NO: 121142
  derived and/or modified sequence opt2 from neuraminidase__InfluenzaB__AGX22242

SEQ ID NO: 121173 - RNA, 1401 nt, Artificial Sequence; identical to SEQ ID NO: 120641
  derived and/or modified sequence opt2 from neuraminidase__InfluenzaB__AGX22253

SEQ ID NO: 121174 - RNA, 1401 nt, Artificial Sequence; identical to SEQ ID NO: 120255
  derived and/or modified sequence opt2 from neuraminidase__InfluenzaB__AGX22264

SEQ ID NO: 121175 - RNA, 1401 nt, Artificial Sequence; identical to SEQ ID NO: 120641
  derived and/or modified sequence opt2 from neuraminidase__InfluenzaB__AGX22275

SEQ ID NO: 121176 - RNA, 1401 nt, Artificial Sequence; identical to SEQ ID NO: 120255
  derived and/or modified sequence opt2 from neuraminidase__InfluenzaB__AGX22286

SEQ ID NO: 121177 - RNA, 1401 nt, Artificial Sequence
  derived and/or modified sequence opt2 from neuraminidase__InfluenzaB__AGX22297
augcuccccuccaccauccagacccucacccucuuccucacccucggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121178 - RNA, 1401 nt, Artificial Sequence; identical to SEQ ID NO: 120255
  derived and/or modified sequence opt2 from neuraminidase__InfluenzaB__AGX22308

SEQ ID NO: 121179 - RNA, 1401 nt, Artificial Sequence
  derived and/or modified sequence opt2 from neuraminidase__InfluenzaB__AGX22330
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacaugaccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccaccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121180 - RNA, 1401 nt, Artificial Sequence; identical to SEQ ID NO: 120643
  derived and/or modified sequence opt2 from neuraminidase__InfluenzaB__AGX22341

SEQ ID NO: 121181 - RNA, 1401 nt, Artificial Sequence; identical to SEQ ID NO: 120643
  derived and/or modified sequence opt2 from neuraminidase__InfluenzaB__AGX22352

SEQ ID NO: 121182 - RNA, 1401 nt, Artificial Sequence; identical to SEQ ID NO: 120643
  derived and/or modified sequence opt2 from neuraminidase__InfluenzaB__AGX22363

SEQ ID NO: 121183 - RNA, 1401 nt, Artificial Sequence; identical to SEQ ID NO: 120641
  derived and/or modified sequence opt2 from neuraminidase__InfluenzaB__AGX22374

SEQ ID NO: 121184 - RNA, 1401 nt, Artificial Sequence; identical to SEQ ID NO: 120255
  derived and/or modified sequence opt2 from neuraminidase__InfluenzaB__AGX22385

SEQ ID NO: 121185 - RNA, 1401 nt, Artificial Sequence; identical to SEQ ID NO: 120255
  derived and/or modified sequence opt2 from neuraminidase__InfluenzaB__AGX22396

SEQ ID NO: 121186 - RNA, 1401 nt, Artificial Sequence; identical to SEQ ID NO: 121142
  derived and/or modified sequence opt2 from neuraminidase__InfluenzaB__AGX22407

SEQ ID NO: 121187 - RNA, 1401 nt, Artificial Sequence
  derived and/or modified sequence opt2 from neuraminidase__InfluenzaB__AGX22418
augcuccccuccaccauccagacccucacccucuuccucaccuccggcggcguccuccucucccucuacgucuccgccucccucuccuaccuccucuacuccgacauccuccucaaguucucccagaccgagaucaucgcccccaucaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggccgcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121188 - RNA, 1401 nt, Artificial Sequence; identical to SEQ ID NO: 120641
  derived and/or modified sequence opt2 from neuraminidase__InfluenzaB__AGX22429

SEQ ID NO: 121189 - RNA, 1401 nt, Artificial Sequence; identical to SEQ ID NO: 120641
  derived and/or modified sequence opt2 from neuraminidase__InfluenzaB__AGX22440

SEQ ID NO: 121190 - RNA, 1401 nt, Artificial Sequence; identical to SEQ ID NO: 120641
  derived and/or modified sequence opt2 from neuraminidase__InfluenzaB__AGX22449

SEQ ID NO: 121191 - RNA, 1401 nt, Artificial Sequence
  derived and/or modified sequence opt2 from neuraminidase__InfluenzaB__AGX22460
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccaccaagggcgucacccuccuccuccccgagcucgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucgacgucgagaccgacaccgccgagauccgccucaugugcaccgagaccuaccucgacaccccccgccccaacgacggcuccaucaccggccccugcgaggccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121192 - RNA, 1401 nt, Artificial Sequence; identical to SEQ ID NO: 120255
  derived and/or modified sequence opt2 from neuraminidase__InfluenzaB__AGX22471

SEQ ID NO: 121193 - RNA, 1401 nt, Artificial Sequence; identical to SEQ ID NO: 120255
  derived and/or modified sequence opt2 from neuraminidase__InfluenzaB__AGX22482

SEQ ID NO: 121194 - RNA, 1401 nt, Artificial Sequence; identical to SEQ ID NO: 120255
  derived and/or modified sequence opt2 from neuraminidase__InfluenzaB__AGX22493

SEQ ID NO: 121195 - RNA, 1401 nt, Artificial Sequence
  derived and/or modified sequence opt2 from neuraminidase__InfluenzaB__AGX22504
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaucccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121196 - RNA, 1401 nt, Artificial Sequence; identical to SEQ ID NO: 120641
  derived and/or modified sequence opt2 from neuraminidase__InfluenzaB__AGX22515

SEQ ID NO: 121197 - RNA, 1401 nt, Artificial Sequence
  derived and/or modified sequence opt2 from neuraminidase__InfluenzaB__AGX22526
augcuccccuccaccauccagacccucacccucuuccucaccuccggcggcguccuccucucccucuacgucuccgccucccucuccuaccuccucuacuccgacauccuccagaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121198 - RNA, 1401 nt, Artificial Sequence; identical to SEQ ID NO: 120300
  derived and/or modified sequence opt2 from neuraminidase__InfluenzaB__AGX22548

SEQ ID NO: 121199 - RNA, 1401 nt, Artificial Sequence; identical to SEQ ID NO: 120139
  derived and/or modified sequence opt2 from neuraminidase__InfluenzaB__AGX22559

SEQ ID NO: 121200 - RNA, 1401 nt, Artificial Sequence; identical to SEQ ID NO: 120300
  derived and/or modified sequence opt2 from neuraminidase__InfluenzaB__AGX22570

SEQ ID NO: 121201 - RNA, 1401 nt, Artificial Sequence
  derived and/or modified sequence opt2 from neuraminidase__InfluenzaB__AGX22581
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacaacaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacaacuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121202 - RNA, 1401 nt, Artificial Sequence; identical to SEQ ID NO: 120300
  derived and/or modified sequence opt2 from neuraminidase__InfluenzaB__AGX22592

SEQ ID NO: 121203 - RNA, 1401 nt, Artificial Sequence; identical to SEQ ID NO: 120300
  derived and/or modified sequence opt2 from neuraminidase__InfluenzaB__AGX22603

SEQ ID NO: 121204 - RNA, 1401 nt, Artificial Sequence; identical to SEQ ID NO: 120540
  derived and/or modified sequence opt2 from neuraminidase__InfluenzaB__AGX22614

SEQ ID NO: 121205 - RNA, 1401 nt, Artificial Sequence; identical to SEQ ID NO: 120300
  derived and/or modified sequence opt2 from neuraminidase__InfluenzaB__AGX22625

SEQ ID NO: 121206 - RNA, 1401 nt, Artificial Sequence
  derived and/or modified sequence opt2 from neuraminidase__InfluenzaB__AGX22636
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucgcccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121207 - RNA, 1401 nt, Artificial Sequence; identical to SEQ ID NO: 120300
  derived and/or modified sequence opt2 from neuraminidase__InfluenzaB__AGX22647

SEQ ID NO: 121208 - RNA, 1401 nt, Artificial Sequence; identical to SEQ ID NO: 120139
  derived and/or modified sequence opt2 from neuraminidase__InfluenzaB__AGX22658

SEQ ID NO: 121209 - RNA, 1401 nt, Artificial Sequence; identical to SEQ ID NO: 120300
  derived and/or modified sequence opt2 from neuraminidase__InfluenzaB__AGX22669

SEQ ID NO: 121210 - RNA, 1401 nt, Artificial Sequence; identical to SEQ ID NO: 120300
  derived and/or modified sequence opt2 from neuraminidase__InfluenzaB__AGX22680

SEQ ID NO: 121211 - RNA, 1401 nt, Artificial Sequence; identical to SEQ ID NO: 120300
  derived and/or modified sequence opt2 from neuraminidase__InfluenzaB__AGX22691

SEQ ID NO: 121212 - RNA, 1401 nt, Artificial Sequence; identical to SEQ ID NO: 120300
  derived and/or modified sequence opt2 from neuraminidase__InfluenzaB__AGX22702

SEQ ID NO: 121213 - RNA, 1401 nt, Artificial Sequence; identical to SEQ ID NO: 120300
  derived and/or modified sequence opt2 from neuraminidase__InfluenzaB__AGX22713

SEQ ID NO: 121214 - RNA, 1401 nt, Artificial Sequence
  derived and/or modified sequence opt2 from neuraminidase__InfluenzaB__AGX22724
augcuccccuccaccauccagacccucacccucuuccucaccuccggcggcguccuccucucccucuacgucuccgcccuccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121215 - RNA, 1401 nt, Artificial Sequence; identical to SEQ ID NO: 120300
  derived and/or modified sequence opt2 from neuraminidase__InfluenzaB__AGX22735

SEQ ID NO: 121216 - RNA, 1401 nt, Artificial Sequence
  derived and/or modified sequence opt2 from neuraminidase__InfluenzaB__AGX22746
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaaccgcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121217 - RNA, 1401 nt, Artificial Sequence; identical to SEQ ID NO: 120300
  derived and/or modified sequence opt2 from neuraminidase__InfluenzaB__AGX22757

SEQ ID NO: 121218 - RNA, 1401 nt, Artificial Sequence; identical to SEQ ID NO: 120300
  derived and/or modified sequence opt2 from neuraminidase__InfluenzaB__AGX22768

SEQ ID NO: 121219 - RNA, 1401 nt, Artificial Sequence; identical to SEQ ID NO: 120641
  derived and/or modified sequence opt2 from neuraminidase__InfluenzaB__AGX22779

SEQ ID NO: 121220 - RNA, 1401 nt, Artificial Sequence; identical to SEQ ID NO: 120300
  derived and/or modified sequence opt2 from neuraminidase__InfluenzaB__AGX22790

SEQ ID NO: 121221 - RNA, 1401 nt, Artificial Sequence
  derived and/or modified sequence opt2 from neuraminidase__InfluenzaB__AGX22801
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121222 - RNA, 1401 nt, Artificial Sequence; identical to SEQ ID NO: 120300
  derived and/or modified sequence opt2 from neuraminidase__InfluenzaB__AGX22812

SEQ ID NO: 121223 - RNA, 1401 nt, Artificial Sequence; identical to SEQ ID NO: 120300
  derived and/or modified sequence opt2 from neuraminidase__InfluenzaB__AGX22823

SEQ ID NO: 121224 - RNA, 1401 nt, Artificial Sequence; identical to SEQ ID NO: 120300
  derived and/or modified sequence opt2 from neuraminidase__InfluenzaB__AGX22834

SEQ ID NO: 121225 - RNA, 1401 nt, Artificial Sequence; identical to SEQ ID NO: 120300
  derived and/or modified sequence opt2 from neuraminidase__InfluenzaB__AGX22845

SEQ ID NO: 121226 - RNA, 1401 nt, Artificial Sequence; identical to SEQ ID NO: 120300
  derived and/or modified sequence opt2 from neuraminidase__InfluenzaB__AGX22856

SEQ ID NO: 121227 - RNA, 1401 nt, Artificial Sequence; identical to SEQ ID NO: 120300
  derived and/or modified sequence opt2 from neuraminidase__InfluenzaB__AGX22867

SEQ ID NO: 121228 - RNA, 1401 nt, Artificial Sequence; identical to SEQ ID NO: 120300
  derived and/or modified sequence opt2 from neuraminidase__InfluenzaB__AGX22878

SEQ ID NO: 121229 - RNA, 1401 nt, Artificial Sequence
  derived and/or modified sequence opt2 from neuraminidase__InfluenzaB__AGX22889
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacucccacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121230 - RNA, 1401 nt, Artificial Sequence; identical to SEQ ID NO: 120139
  derived and/or modified sequence opt2 from neuraminidase__InfluenzaB__AGX22900

SEQ ID NO: 121231 - RNA, 1401 nt, Artificial Sequence
  derived and/or modified sequence opt2 from neuraminidase__InfluenzaB__AGX22911
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaccuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121232 - RNA, 1401 nt, Artificial Sequence
  derived and/or modified sequence opt2 from neuraminidase__InfluenzaB__AGX22922
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacaacgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121233 - RNA, 1401 nt, Artificial Sequence; identical to SEQ ID NO: 120300
  derived and/or modified sequence opt2 from neuraminidase__InfluenzaB__AGX22933

SEQ ID NO: 121234 - RNA, 1401 nt, Artificial Sequence; identical to SEQ ID NO: 120300
  derived and/or modified sequence opt2 from neuraminidase__InfluenzaB__AGX22944

SEQ ID NO: 121235 - RNA, 1401 nt, Artificial Sequence; identical to SEQ ID NO: 120300
  derived and/or modified sequence opt2 from neuraminidase__InfluenzaB__AGX22955

SEQ ID NO: 121236 - RNA, 1401 nt, Artificial Sequence; identical to SEQ ID NO: 120300
  derived and/or modified sequence opt2 from neuraminidase__InfluenzaB__AGX22966

SEQ ID NO: 121237 - RNA, 1401 nt, Artificial Sequence; identical to SEQ ID NO: 120139
  derived and/or modified sequence opt2 from neuraminidase__InfluenzaB__AGX22977

SEQ ID NO: 121238 - RNA, 1401 nt, Artificial Sequence; identical to SEQ ID NO: 120555
  derived and/or modified sequence opt2 from neuraminidase__InfluenzaB__AGX22988

SEQ ID NO: 121239 - RNA, 1401 nt, Artificial Sequence
  derived and/or modified sequence opt2 from neuraminidase__InfluenzaB__AGX22999
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgagugggccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121240 - RNA, 1401 nt, Artificial Sequence; identical to SEQ ID NO: 121239
  derived and/or modified sequence opt2 from neuraminidase__InfluenzaB__AGX23010

SEQ ID NO: 121241 - RNA, 1401 nt, Artificial Sequence; identical to SEQ ID NO: 120139
  derived and/or modified sequence opt2 from neuraminidase__InfluenzaB__AGX23021

SEQ ID NO: 121242 - RNA, 1401 nt, Artificial Sequence; identical to SEQ ID NO: 120300
  derived and/or modified sequence opt2 from neuraminidase__InfluenzaB__AGX23032

SEQ ID NO: 121243 - RNA, 1401 nt, Artificial Sequence
  derived and/or modified sequence opt2 from neuraminidase__InfluenzaB__AGX23043
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgcccucggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121244 - RNA, 1401 nt, Artificial Sequence; identical to SEQ ID NO: 120139
  derived and/or modified sequence opt2 from neuraminidase__InfluenzaB__AGX23054

SEQ ID NO: 121245 - RNA, 1401 nt, Artificial Sequence; identical to SEQ ID NO: 120139
  derived and/or modified sequence opt2 from neuraminidase__InfluenzaB__AGX23065

SEQ ID NO: 121246 - RNA, 1401 nt, Artificial Sequence; identical to SEQ ID NO: 120139
  derived and/or modified sequence opt2 from neuraminidase__InfluenzaB__AGX23076

SEQ ID NO: 121247 - RNA, 1401 nt, Artificial Sequence; identical to SEQ ID NO: 120300
  derived and/or modified sequence opt2 from neuraminidase__InfluenzaB__AGX23087

SEQ ID NO: 121248 - RNA, 1401 nt, Artificial Sequence; identical to SEQ ID NO: 120139
  derived and/or modified sequence opt2 from neuraminidase__InfluenzaB__AGX23098

SEQ ID NO: 121249 - RNA, 1401 nt, Artificial Sequence
  derived and/or modified sequence opt2 from neuraminidase__InfluenzaB__AGX23109
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcauccgcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121250 - RNA, 1401 nt, Artificial Sequence; identical to SEQ ID NO: 120300
  derived and/or modified sequence opt2 from neuraminidase__InfluenzaB__AGX23120

SEQ ID NO: 121251 - RNA, 1401 nt, Artificial Sequence
  derived and/or modified sequence opt2 from neuraminidase__InfluenzaB__AGX23131
augcuccccuccaccauccagacccucacccucuuccucaccuccggcggcguccuccucucccucuacgucuccgccucccucuccuaccuccucuacuccgacauccuccucaaguucucccagaccgagaucaucgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121252 - RNA, 1401 nt, Artificial Sequence; identical to SEQ ID NO: 120300
  derived and/or modified sequence opt2 from neuraminidase__InfluenzaB__AGX23142

SEQ ID NO: 121253 - RNA, 1401 nt, Artificial Sequence; identical to SEQ ID NO: 120139
  derived and/or modified sequence opt2 from neuraminidase__InfluenzaB__AGX23153

SEQ ID NO: 121254 - RNA, 1401 nt, Artificial Sequence; identical to SEQ ID NO: 120139
  derived and/or modified sequence opt2 from neuraminidase__InfluenzaB__AGX23164

SEQ ID NO: 121255 - RNA, 1401 nt, Artificial Sequence; identical to SEQ ID NO: 120139
  derived and/or modified sequence opt2 from neuraminidase__InfluenzaB__AGX23175

SEQ ID NO: 121256 - RNA, 1401 nt, Artificial Sequence
  derived and/or modified sequence opt2 from neuraminidase__InfluenzaB__AGX23186
augcuccccuccaccacccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121257 - RNA, 1401 nt, Artificial Sequence; identical to SEQ ID NO: 120300
  derived and/or modified sequence opt2 from neuraminidase__InfluenzaB__AGX23197

SEQ ID NO: 121258 - RNA, 1401 nt, Artificial Sequence; identical to SEQ ID NO: 120300
  derived and/or modified sequence opt2 from neuraminidase__InfluenzaB__AGX23208

SEQ ID NO: 121259 - RNA, 1401 nt, Artificial Sequence; identical to SEQ ID NO: 120300
  derived and/or modified sequence opt2 from neuraminidase__InfluenzaB__AGX23219

SEQ ID NO: 121260 - RNA, 1401 nt, Artificial Sequence
  derived and/or modified sequence opt2 from neuraminidase__InfluenzaB__AGX23230
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcgaguacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccuccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121261 - RNA, 1401 nt, Artificial Sequence; identical to SEQ ID NO: 120139
  derived and/or modified sequence opt2 from neuraminidase__InfluenzaB__AGX23241

SEQ ID NO: 121262 - RNA, 1401 nt, Artificial Sequence; identical to SEQ ID NO: 120300
  derived and/or modified sequence opt2 from neuraminidase__InfluenzaB__AGX23252

SEQ ID NO: 121263 - RNA, 1401 nt, Artificial Sequence; identical to SEQ ID NO: 120300
  derived and/or modified sequence opt2 from neuraminidase__InfluenzaB__AGX23263

SEQ ID NO: 121264 - RNA, 1401 nt, Artificial Sequence; identical to SEQ ID NO: 120300
  derived and/or modified sequence opt2 from neuraminidase__InfluenzaB__AGX23274

SEQ ID NO: 121265 - RNA, 1401 nt, Artificial Sequence; identical to SEQ ID NO: 120139
  derived and/or modified sequence opt2 from neuraminidase__InfluenzaB__AGX23285

SEQ ID NO: 121266 - RNA, 1401 nt, Artificial Sequence; identical to SEQ ID NO: 120300
  derived and/or modified sequence opt2 from neuraminidase__InfluenzaB__AGX23296

SEQ ID NO: 121267 - RNA, 1401 nt, Artificial Sequence
  derived and/or modified sequence opt2 from neuraminidase__InfluenzaB__AGX23307
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121268 - RNA, 1401 nt, Artificial Sequence; identical to SEQ ID NO: 121267
  derived and/or modified sequence opt2 from neuraminidase__InfluenzaB__AGX23318

SEQ ID NO: 121269 - RNA, 1401 nt, Artificial Sequence; identical to SEQ ID NO: 121267
  derived and/or modified sequence opt2 from neuraminidase__InfluenzaB__AGX23329

SEQ ID NO: 121270 - RNA, 1401 nt, Artificial Sequence; identical to SEQ ID NO: 121267
  derived and/or modified sequence opt2 from neuraminidase__InfluenzaB__AGX23340

SEQ ID NO: 121271 - RNA, 1401 nt, Artificial Sequence; identical to SEQ ID NO: 121267
  derived and/or modified sequence opt2 from neuraminidase__InfluenzaB__AGX23351

SEQ ID NO: 121272 - RNA, 1401 nt, Artificial Sequence; identical to SEQ ID NO: 121267
  derived and/or modified sequence opt2 from neuraminidase__InfluenzaB__AGX23362

SEQ ID NO: 121273 - RNA, 1401 nt, Artificial Sequence; identical to SEQ ID NO: 121267
  derived and/or modified sequence opt2 from neuraminidase__InfluenzaB__AGX23373

SEQ ID NO: 121274 - RNA, 1401 nt, Artificial Sequence; identical to SEQ ID NO: 121267
  derived and/or modified sequence opt2 from neuraminidase__InfluenzaB__AGX23384

SEQ ID NO: 121275 - RNA, 1401 nt, Artificial Sequence
  derived and/or modified sequence opt2 from neuraminidase__InfluenzaB__AGX23395
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucuggaacaccgucaccggcgucgacauggcccucuga

SEQ ID NO: 121276 - RNA, 1401 nt, Artificial Sequence
  derived and/or modified sequence opt2 from neuraminidase__InfluenzaB__AGX23417
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121277 - RNA, 1401 nt, Artificial Sequence; identical to SEQ ID NO: 121276
  derived and/or modified sequence opt2 from neuraminidase__InfluenzaB__AGX23428

SEQ ID NO: 121278 - RNA, 1401 nt, Artificial Sequence; identical to SEQ ID NO: 120659
  derived and/or modified sequence opt2 from neuraminidase__InfluenzaB__AGX23450

SEQ ID NO: 121279 - RNA, 1401 nt, Artificial Sequence
  derived and/or modified sequence opt2 from neuraminidase__InfluenzaB__AGX23461
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacauccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121280 - RNA, 1401 nt, Artificial Sequence; identical to SEQ ID NO: 120659
  derived and/or modified sequence opt2 from neuraminidase__InfluenzaB__AGX23472

SEQ ID NO: 121281 - RNA, 1401 nt, Artificial Sequence; identical to SEQ ID NO: 120300
  derived and/or modified sequence opt2 from neuraminidase__InfluenzaB__AGX23483

SEQ ID NO: 121282 - RNA, 1401 nt, Artificial Sequence
  derived and/or modified sequence opt2 from neuraminidase__InfluenzaB__AGX23494
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcggcuccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121283 - RNA, 1401 nt, Artificial Sequence
  derived and/or modified sequence opt2 from neuraminidase__InfluenzaB__AGX23505
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121284 - RNA, 1401 nt, Artificial Sequence
  derived and/or modified sequence opt2 from neuraminidase__InfluenzaB__AGX23516
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaaggccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121285 - RNA, 1401 nt, Artificial Sequence; identical to SEQ ID NO: 120300
  derived and/or modified sequence opt2 from neuraminidase__InfluenzaB__AGX23527

SEQ ID NO: 121286 - RNA, 1401 nt, Artificial Sequence
  derived and/or modified sequence opt2 from neuraminidase__InfluenzaB__AGX23538
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccaagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaccaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121287 - RNA, 1401 nt, Artificial Sequence
  derived and/or modified sequence opt2 from neuraminidase__InfluenzaB__AGX23549
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaccaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121288 - RNA, 1401 nt, Artificial Sequence; identical to SEQ ID NO: 120300
  derived and/or modified sequence opt2 from neuraminidase__InfluenzaB__AGX23560

SEQ ID NO: 121289 - RNA, 1401 nt, Artificial Sequence; identical to SEQ ID NO: 121282
  derived and/or modified sequence opt2 from neuraminidase__InfluenzaB__AGX23571

SEQ ID NO: 121290 - RNA, 1401 nt, Artificial Sequence; identical to SEQ ID NO: 121282
  derived and/or modified sequence opt2 from neuraminidase__InfluenzaB__AGX23582

SEQ ID NO: 121291 - RNA, 1401 nt, Artificial Sequence
  derived and/or modified sequence opt2 from neuraminidase__InfluenzaB__AGX23593
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucacccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121292 - RNA, 1401 nt, Artificial Sequence; identical to SEQ ID NO: 120300
  derived and/or modified sequence opt2 from neuraminidase__InfluenzaB__AGX23604

SEQ ID NO: 121293 - RNA, 1401 nt, Artificial Sequence
  derived and/or modified sequence opt2 from neuraminidase__InfluenzaB__AGX23615
augcuccccuccaccauccagacccucacccucuuccucaccuccggcggcguccuccucucccucuacgucuccgccucccucuccuaccuccucuacuccgacauccuccucaaguucucccagaccgagaucaccacccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121294 - RNA, 1401 nt, Artificial Sequence; identical to SEQ ID NO: 121282
  derived and/or modified sequence opt2 from neuraminidase__InfluenzaB__AGX23626

SEQ ID NO: 121295 - RNA, 1401 nt, Artificial Sequence; identical to SEQ ID NO: 120659
  derived and/or modified sequence opt2 from neuraminidase__InfluenzaB__AGX23637

SEQ ID NO: 121296 - RNA, 1401 nt, Artificial Sequence; identical to SEQ ID NO: 120300
  derived and/or modified sequence opt2 from neuraminidase__InfluenzaB__AGX23659

SEQ ID NO: 121297 - RNA, 1401 nt, Artificial Sequence; identical to SEQ ID NO: 120659
  derived and/or modified sequence opt2 from neuraminidase__InfluenzaB__AGX23670

SEQ ID NO: 121298 - RNA, 1401 nt, Artificial Sequence; identical to SEQ ID NO: 120659
  derived and/or modified sequence opt2 from neuraminidase__InfluenzaB__AGX23681

SEQ ID NO: 121299 - RNA, 1401 nt, Artificial Sequence; identical to SEQ ID NO: 120659
  derived and/or modified sequence opt2 from neuraminidase__InfluenzaB__AGX23692

SEQ ID NO: 121300 - RNA, 1401 nt, Artificial Sequence; identical to SEQ ID NO: 120659
  derived and/or modified sequence opt2 from neuraminidase__InfluenzaB__AGX23703

SEQ ID NO: 121301 - RNA, 1401 nt, Artificial Sequence
  derived and/or modified sequence opt2 from neuraminidase__InfluenzaB__AGX23714
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgagaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcggcuccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121302 - RNA, 1401 nt, Artificial Sequence; identical to SEQ ID NO: 120659
  derived and/or modified sequence opt2 from neuraminidase__InfluenzaB__AGX23725

SEQ ID NO: 121303 - RNA, 1401 nt, Artificial Sequence; identical to SEQ ID NO: 121282
  derived and/or modified sequence opt2 from neuraminidase__InfluenzaB__AGX23736

SEQ ID NO: 121304 - RNA, 1401 nt, Artificial Sequence; identical to SEQ ID NO: 120659
  derived and/or modified sequence opt2 from neuraminidase__InfluenzaB__AGX23747

SEQ ID NO: 121305 - RNA, 1401 nt, Artificial Sequence; identical to SEQ ID NO: 120659
  derived and/or modified sequence opt2 from neuraminidase__InfluenzaB__AGX23758

SEQ ID NO: 121306 - RNA, 1401 nt, Artificial Sequence; identical to SEQ ID NO: 121282
  derived and/or modified sequence opt2 from neuraminidase__InfluenzaB__AGX23769

SEQ ID NO: 121307 - RNA, 1401 nt, Artificial Sequence
  derived and/or modified sequence opt2 from neuraminidase__InfluenzaB__AGX23780
augcuccccuccaccauccagacccucacccuccuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121308 - RNA, 1401 nt, Artificial Sequence
  derived and/or modified sequence opt2 from neuraminidase__InfluenzaB__AGX23791
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacgcccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121309 - RNA, 1401 nt, Artificial Sequence; identical to SEQ ID NO: 121282
  derived and/or modified sequence opt2 from neuraminidase__InfluenzaB__AGX23802

SEQ ID NO: 121310 - RNA, 1401 nt, Artificial Sequence; identical to SEQ ID NO: 121282
  derived and/or modified sequence opt2 from neuraminidase__InfluenzaB__AGX23813

SEQ ID NO: 121311 - RNA, 1401 nt, Artificial Sequence; identical to SEQ ID NO: 121282
  derived and/or modified sequence opt2 from neuraminidase__InfluenzaB__AGX23824

SEQ ID NO: 121312 - RNA, 1401 nt, Artificial Sequence; identical to SEQ ID NO: 121282
  derived and/or modified sequence opt2 from neuraminidase__InfluenzaB__AGX23846

SEQ ID NO: 121313 - RNA, 1401 nt, Artificial Sequence; identical to SEQ ID NO: 120300
  derived and/or modified sequence opt2 from neuraminidase__InfluenzaB__AGX23857

SEQ ID NO: 121314 - RNA, 1401 nt, Artificial Sequence; identical to SEQ ID NO: 121282
  derived and/or modified sequence opt2 from neuraminidase__InfluenzaB__AGX23868

SEQ ID NO: 121315 - RNA, 1401 nt, Artificial Sequence
  derived and/or modified sequence opt2 from neuraminidase__InfluenzaB__AGX23879
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaccuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121316 - RNA, 1401 nt, Artificial Sequence; identical to SEQ ID NO: 121282
  derived and/or modified sequence opt2 from neuraminidase__InfluenzaB__AGX23890

SEQ ID NO: 121317 - RNA, 1401 nt, Artificial Sequence; identical to SEQ ID NO: 120300
  derived and/or modified sequence opt2 from neuraminidase__InfluenzaB__AGX23901

SEQ ID NO: 121318 - RNA, 1401 nt, Artificial Sequence
  derived and/or modified sequence opt2 from neuraminidase__InfluenzaB__AGX23912
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaaccgccuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcggcuccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121319 - RNA, 1401 nt, Artificial Sequence; identical to SEQ ID NO: 120472
  derived and/or modified sequence opt2 from neuraminidase__InfluenzaB__AGX23934

SEQ ID NO: 121320 - RNA, 1401 nt, Artificial Sequence
  derived and/or modified sequence opt2 from neuraminidase__InfluenzaB__AGX23945
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcaucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcggcuccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121321 - RNA, 1401 nt, Artificial Sequence
  derived and/or modified sequence opt2 from neuraminidase__InfluenzaB__AGX23956
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcaucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121322 - RNA, 1401 nt, Artificial Sequence; identical to SEQ ID NO: 120659
  derived and/or modified sequence opt2 from neuraminidase__InfluenzaB__AGX23967

SEQ ID NO: 121323 - RNA, 1401 nt, Artificial Sequence; identical to SEQ ID NO: 120472
  derived and/or modified sequence opt2 from neuraminidase__InfluenzaB__AGX23978

SEQ ID NO: 121324 - RNA, 1401 nt, Artificial Sequence
  derived and/or modified sequence opt2 from neuraminidase__InfluenzaB__AGX23989
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaaggccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccggcgcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121325 - RNA, 1401 nt, Artificial Sequence; identical to SEQ ID NO: 121282
  derived and/or modified sequence opt2 from neuraminidase__InfluenzaB__AGX24000

SEQ ID NO: 121326 - RNA, 1401 nt, Artificial Sequence
  derived and/or modified sequence opt2 from neuraminidase__InfluenzaB__AGX24011
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacuacgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaucgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121327 - RNA, 1401 nt, Artificial Sequence; identical to SEQ ID NO: 120472
  derived and/or modified sequence opt2 from neuraminidase__InfluenzaB__AGX24022

SEQ ID NO: 121328 - RNA, 1401 nt, Artificial Sequence
  derived and/or modified sequence opt2 from neuraminidase__InfluenzaB__AGX24033
augcuccccuccaccauccagacccucacccucuuccucaccuccggcggcguccuccucucccucuacgucuccgccucccucuccuaccuccucuacuccgacauccuccucaaguucucccagaccgagaucaccgcccagaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaaggccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccggcgcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121329 - RNA, 1401 nt, Artificial Sequence; identical to SEQ ID NO: 120472
  derived and/or modified sequence opt2 from neuraminidase__InfluenzaB__AGX24044

SEQ ID NO: 121330 - RNA, 1401 nt, Artificial Sequence
  derived and/or modified sequence opt2 from neuraminidase__InfluenzaB__AGX24055
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcucgaguggaccuacccccgccucuccugccccggcuccaccuuccagaaggcccuccucaucuccccccaccgcuucggcgagaccaagggcaacuccgccccccucaucauccgcgagcccuucgucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccaacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121331 - RNA, 1401 nt, Artificial Sequence; identical to SEQ ID NO: 120329
  derived and/or modified sequence opt2 from neuraminidase__InfluenzaB__AGX24066

SEQ ID NO: 121332 - RNA, 1401 nt, Artificial Sequence
  derived and/or modified sequence opt2 from neuraminidase__InfluenzaB__AGX24077
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcaacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaaggccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccggcgcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121333 - RNA, 1401 nt, Artificial Sequence
  derived and/or modified sequence opt2 from neuraminidase__InfluenzaB__AGX24088
augcuccccuccaccauccagacccucacccucuucaucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccgacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcggcuccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121334 - RNA, 1401 nt, Artificial Sequence; identical to SEQ ID NO: 120472
  derived and/or modified sequence opt2 from neuraminidase__InfluenzaB__AGX24099

SEQ ID NO: 121335 - RNA, 1401 nt, Artificial Sequence
  derived and/or modified sequence opt2 from neuraminidase__InfluenzaB__AGX24110
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcaccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcggcuccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121336 - RNA, 1401 nt, Artificial Sequence
  derived and/or modified sequence opt2 from neuraminidase__InfluenzaB__AGX24121
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacuacgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgccaagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121337 - RNA, 1401 nt, Artificial Sequence
  derived and/or modified sequence opt2 from neuraminidase__InfluenzaB__AGX24132
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgcccucggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121338 - RNA, 1401 nt, Artificial Sequence
  derived and/or modified sequence opt2 from neuraminidase__InfluenzaB__AGX24143
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacggcaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121339 - RNA, 1401 nt, Artificial Sequence; identical to SEQ ID NO: 120472
  derived and/or modified sequence opt2 from neuraminidase__InfluenzaB__AGX24154

SEQ ID NO: 121340 - RNA, 1401 nt, Artificial Sequence
  derived and/or modified sequence opt2 from neuraminidase__InfluenzaB__AGX24165
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacuacgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucaacggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121341 - RNA, 1401 nt, Artificial Sequence; identical to SEQ ID NO: 120329
  derived and/or modified sequence opt2 from neuraminidase__InfluenzaB__AGX24176

SEQ ID NO: 121342 - RNA, 1401 nt, Artificial Sequence; identical to SEQ ID NO: 120329
  derived and/or modified sequence opt2 from neuraminidase__InfluenzaB__AGX24187

SEQ ID NO: 121343 - RNA, 1401 nt, Artificial Sequence; identical to SEQ ID NO: 120329
  derived and/or modified sequence opt2 from neuraminidase__InfluenzaB__AGX24198

SEQ ID NO: 121344 - RNA, 1401 nt, Artificial Sequence; identical to SEQ ID NO: 120659
  derived and/or modified sequence opt2 from neuraminidase__InfluenzaB__AGX24231

SEQ ID NO: 121345 - RNA, 1401 nt, Artificial Sequence; identical to SEQ ID NO: 120329
  derived and/or modified sequence opt2 from neuraminidase__InfluenzaB__AGX24242

SEQ ID NO: 121346 - RNA, 1401 nt, Artificial Sequence
  derived and/or modified sequence opt2 from neuraminidase__InfluenzaB__AGX24275
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaaccgcaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121347 - RNA, 1401 nt, Artificial Sequence; identical to SEQ ID NO: 120924
  derived and/or modified sequence opt2 from neuraminidase__InfluenzaB__AGX24286

SEQ ID NO: 121348 - RNA, 1401 nt, Artificial Sequence
  derived and/or modified sequence opt2 from neuraminidase__InfluenzaB__AGX24297
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121349 - RNA, 1401 nt, Artificial Sequence; identical to SEQ ID NO: 120924
  derived and/or modified sequence opt2 from neuraminidase__InfluenzaB__AGX24319

SEQ ID NO: 121350 - RNA, 1401 nt, Artificial Sequence
  derived and/or modified sequence opt2 from neuraminidase__InfluenzaB__AGX24330
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacuacgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcaccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugaucuccauggaggagcccggcugguacuccuucggcuucgagaucaaggacaagaagugcgacguccccugcaucggcaucgagaugguccacgacggcggcaagaccaccugguacuccgccgccaccgccaucuacugccucaugggcuccggccagcuccucugggacaccgucaccggcgucgacauggcccucuga

SEQ ID NO: 121351 - RNA, 1401 nt, Artificial Sequence
  derived and/or modified sequence opt2 from neuraminidase__InfluenzaB__AGX24341
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucacccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121352 - RNA, 1401 nt, Artificial Sequence
  derived and/or modified sequence opt2 from neuraminidase__InfluenzaB__AGX24352
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacaacaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121353 - RNA, 1401 nt, Artificial Sequence; identical to SEQ ID NO: 121348
  derived and/or modified sequence opt2 from neuraminidase__InfluenzaB__AGX24363

SEQ ID NO: 121354 - RNA, 1401 nt, Artificial Sequence; identical to SEQ ID NO: 121352
  derived and/or modified sequence opt2 from neuraminidase__InfluenzaB__AGX24374

SEQ ID NO: 121355 - RNA, 1401 nt, Artificial Sequence
  derived and/or modified sequence opt2 from neuraminidase__InfluenzaB__AGX24385
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121356 - RNA, 1401 nt, Artificial Sequence
  derived and/or modified sequence opt2 from neuraminidase__InfluenzaB__AGX24396
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccggcgcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121357 - RNA, 1401 nt, Artificial Sequence; identical to SEQ ID NO: 121356
  derived and/or modified sequence opt2 from neuraminidase__InfluenzaB__AGX24407

SEQ ID NO: 121358 - RNA, 1401 nt, Artificial Sequence; identical to SEQ ID NO: 120329
  derived and/or modified sequence opt2 from neuraminidase__InfluenzaB__AGX24418

SEQ ID NO: 121359 - RNA, 1401 nt, Artificial Sequence; identical to SEQ ID NO: 120300
  derived and/or modified sequence opt2 from neuraminidase__InfluenzaB__AGX24429

SEQ ID NO: 121360 - RNA, 1401 nt, Artificial Sequence
  derived and/or modified sequence opt2 from neuraminidase__InfluenzaB__AGX24440
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggcaccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccggcgcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccaccaucuacugccucaugggcuccggccagcuccucugggacaccgucaccggcgucgacauggcccucuga

SEQ ID NO: 121361 - RNA, 1401 nt, Artificial Sequence; identical to SEQ ID NO: 120924
  derived and/or modified sequence opt2 from neuraminidase__InfluenzaB__AGX24451

SEQ ID NO: 121362 - RNA, 1401 nt, Artificial Sequence
  derived and/or modified sequence opt2 from neuraminidase__InfluenzaB__AGX24462
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacuacgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugaucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121363 - RNA, 1401 nt, Artificial Sequence; identical to SEQ ID NO: 121362
  derived and/or modified sequence opt2 from neuraminidase__InfluenzaB__AGX24473

SEQ ID NO: 121364 - RNA, 1401 nt, Artificial Sequence
  derived and/or modified sequence opt2 from neuraminidase__InfluenzaB__AGX24484
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacggcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121365 - RNA, 1401 nt, Artificial Sequence
  derived and/or modified sequence opt2 from neuraminidase__InfluenzaB__AGX24495
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggucgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121366 - RNA, 1401 nt, Artificial Sequence; identical to SEQ ID NO: 120924
  derived and/or modified sequence opt2 from neuraminidase__InfluenzaB__AGX24506

SEQ ID NO: 121367 - RNA, 1401 nt, Artificial Sequence
  derived and/or modified sequence opt2 from neuraminidase__InfluenzaB__AGX24517
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121368 - RNA, 1401 nt, Artificial Sequence; identical to SEQ ID NO: 120924
  derived and/or modified sequence opt2 from neuraminidase__InfluenzaB__AGX24528

SEQ ID NO: 121369 - RNA, 1401 nt, Artificial Sequence; identical to SEQ ID NO: 121352
  derived and/or modified sequence opt2 from neuraminidase__InfluenzaB__AGX24539

SEQ ID NO: 121370 - RNA, 1401 nt, Artificial Sequence
  derived and/or modified sequence opt2 from neuraminidase__InfluenzaB__AGX24550
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccucauccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121371 - RNA, 1401 nt, Artificial Sequence; identical to SEQ ID NO: 121362
  derived and/or modified sequence opt2 from neuraminidase__InfluenzaB__AGX24561

SEQ ID NO: 121372 - RNA, 1401 nt, Artificial Sequence; identical to SEQ ID NO: 120329
  derived and/or modified sequence opt2 from neuraminidase__InfluenzaB__AGX24572

SEQ ID NO: 121373 - RNA, 1401 nt, Artificial Sequence
  derived and/or modified sequence opt2 from neuraminidase__InfluenzaB__AGX24583
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccggcgcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121374 - RNA, 1401 nt, Artificial Sequence; identical to SEQ ID NO: 120924
  derived and/or modified sequence opt2 from neuraminidase__InfluenzaB__AGX24594

SEQ ID NO: 121375 - RNA, 1401 nt, Artificial Sequence; identical to SEQ ID NO: 120924
  derived and/or modified sequence opt2 from neuraminidase__InfluenzaB__AGX24605

SEQ ID NO: 121376 - RNA, 1401 nt, Artificial Sequence; identical to SEQ ID NO: 120924
  derived and/or modified sequence opt2 from neuraminidase__InfluenzaB__AGX24616

SEQ ID NO: 121377 - RNA, 1401 nt, Artificial Sequence; identical to SEQ ID NO: 121348
  derived and/or modified sequence opt2 from neuraminidase__InfluenzaB__AGX24627

SEQ ID NO: 121378 - RNA, 1401 nt, Artificial Sequence; identical to SEQ ID NO: 120924
  derived and/or modified sequence opt2 from neuraminidase__InfluenzaB__AGX24638

SEQ ID NO: 121379 - RNA, 1401 nt, Artificial Sequence
  derived and/or modified sequence opt2 from neuraminidase__InfluenzaB__AGX24660
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucaccuacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121380 - RNA, 1401 nt, Artificial Sequence
  derived and/or modified sequence opt2 from neuraminidase__InfluenzaB__AGX24671
augcuccccuccaccauccagacccucacccucuuccucaccuccggcggcguccuccuccuccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacauccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121381 - RNA, 1401 nt, Artificial Sequence
  derived and/or modified sequence opt2 from neuraminidase__InfluenzaB__AGX24682
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucguccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121382 - RNA, 1401 nt, Artificial Sequence; identical to SEQ ID NO: 120924
  derived and/or modified sequence opt2 from neuraminidase__InfluenzaB__AGX24693

SEQ ID NO: 121383 - RNA, 1401 nt, Artificial Sequence; identical to SEQ ID NO: 120924
  derived and/or modified sequence opt2 from neuraminidase__InfluenzaB__AGX24704

SEQ ID NO: 121384 - RNA, 1401 nt, Artificial Sequence; identical to SEQ ID NO: 120924
  derived and/or modified sequence opt2 from neuraminidase__InfluenzaB__AGX24715

SEQ ID NO: 121385 - RNA, 1401 nt, Artificial Sequence
  derived and/or modified sequence opt2 from neuraminidase__InfluenzaB__AGX24737
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggcaccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccggcgcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121386 - RNA, 1401 nt, Artificial Sequence
  derived and/or modified sequence opt2 from neuraminidase__InfluenzaB__AGX24748
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggccgcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccgucuacugccucaugggcuccggccagcuccucugggacaccgucaccggcgucgacauggcccucuga

SEQ ID NO: 121387 - RNA, 1401 nt, Artificial Sequence
  derived and/or modified sequence opt2 from neuraminidase__InfluenzaB__AGX24759
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacauccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121388 - RNA, 1401 nt, Artificial Sequence; identical to SEQ ID NO: 120924
  derived and/or modified sequence opt2 from neuraminidase__InfluenzaB__AGX24770

SEQ ID NO: 121389 - RNA, 1401 nt, Artificial Sequence; identical to SEQ ID NO: 121386
  derived and/or modified sequence opt2 from neuraminidase__InfluenzaB__AGX24781

SEQ ID NO: 121390 - RNA, 1401 nt, Artificial Sequence; identical to SEQ ID NO: 120300
  derived and/or modified sequence opt2 from neuraminidase__InfluenzaB__AGX24792

SEQ ID NO: 121391 - RNA, 1401 nt, Artificial Sequence; identical to SEQ ID NO: 121348
  derived and/or modified sequence opt2 from neuraminidase__InfluenzaB__AGX24803

SEQ ID NO: 121392 - RNA, 1401 nt, Artificial Sequence; identical to SEQ ID NO: 120924
  derived and/or modified sequence opt2 from neuraminidase__InfluenzaB__AGX24814

SEQ ID NO: 121393 - RNA, 1401 nt, Artificial Sequence
  derived and/or modified sequence opt2 from neuraminidase__InfluenzaB__AGX24825
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcgaguacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121394 - RNA, 1401 nt, Artificial Sequence; identical to SEQ ID NO: 120924
  derived and/or modified sequence opt2 from neuraminidase__InfluenzaB__AGX24836

SEQ ID NO: 121395 - RNA, 1401 nt, Artificial Sequence
  derived and/or modified sequence opt2 from neuraminidase__InfluenzaB__AGX24847
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccgucuacugccucaugggcuccggccagcuccucugggacaccgucaccggcgucaacaugacccucuga

SEQ ID NO: 121396 - RNA, 1401 nt, Artificial Sequence; identical to SEQ ID NO: 120408
  derived and/or modified sequence opt2 from neuraminidase__InfluenzaB__AGX24858

SEQ ID NO: 121397 - RNA, 1401 nt, Artificial Sequence
  derived and/or modified sequence opt2 from neuraminidase__InfluenzaB__AGX24869
augcuccccuccaccauccagacccucacccucuuccucaccuccggcggcguccuccucucccucuacgucuccgccucccucuccuaccuccucuacuccgacauccuccucaaguucucccgcaccgagaugaccgcccccaucaugccccucggcugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121398 - RNA, 1401 nt, Artificial Sequence
  derived and/or modified sequence opt2 from neuraminidase__InfluenzaB__AGX24880
augcuccccuccaccauccagaugcucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121399 - RNA, 1401 nt, Artificial Sequence
  derived and/or modified sequence opt2 from neuraminidase__InfluenzaB__AGX24902
augcuccccuccaccauccagacccucacccucuuccucaccuccggcggcguccuccucucccucuacgucuccgcccuccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaacaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacaacuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121400 - RNA, 1401 nt, Artificial Sequence; identical to SEQ ID NO: 120413
  derived and/or modified sequence opt2 from neuraminidase__InfluenzaB__AGX84846

SEQ ID NO: 121401 - RNA, 1401 nt, Artificial Sequence; identical to SEQ ID NO: 120468
  derived and/or modified sequence opt2 from neuraminidase__InfluenzaB__AGX84858

SEQ ID NO: 121402 - RNA, 1401 nt, Artificial Sequence; identical to SEQ ID NO: 120413
  derived and/or modified sequence opt2 from neuraminidase__InfluenzaB__AGX84869

SEQ ID NO: 121403 - RNA, 1401 nt, Artificial Sequence
  derived and/or modified sequence opt2 from neuraminidase__InfluenzaB__AGX84880
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugucccucgacugcgccaacgccuccaacguccaggccgucaaccgcuccgccaccaagggcgucaucuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121404 - RNA, 1401 nt, Artificial Sequence; identical to SEQ ID NO: 120413
  derived and/or modified sequence opt2 from neuraminidase__InfluenzaB__AGX84891

SEQ ID NO: 121405 - RNA, 1401 nt, Artificial Sequence; identical to SEQ ID NO: 120468
  derived and/or modified sequence opt2 from neuraminidase__InfluenzaB__AGX84902

SEQ ID NO: 121406 - RNA, 1401 nt, Artificial Sequence
  derived and/or modified sequence opt2 from neuraminidase__InfluenzaB__AGX84924
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacuacgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121407 - RNA, 1401 nt, Artificial Sequence
  derived and/or modified sequence opt2 from neuraminidase__InfluenzaB__AGY46393
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccaccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaacgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121408 - RNA, 1401 nt, Artificial Sequence
  derived and/or modified sequence opt2 from neuraminidase__InfluenzaB__AGY46397
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121409 - RNA, 1401 nt, Artificial Sequence
  derived and/or modified sequence opt2 from neuraminidase__InfluenzaB__AGY46399
augcuccccuccaccauccagacccucacccucuuccucaccuccggcggcguccuccucucccucuacgucuccgccucccucuccuaccuccucuacuccgacauccuccucaaguucucccccaccgagaucaucgcccccaccaccccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgaggcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121410 - RNA, 1401 nt, Artificial Sequence
  derived and/or modified sequence opt2 from neuraminidase__InfluenzaB__AGY46401
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121411 - RNA, 1401 nt, Artificial Sequence; identical to SEQ ID NO: 120128
  derived and/or modified sequence opt2 from neuraminidase__InfluenzaB__AGZ59825

SEQ ID NO: 121412 - RNA, 1401 nt, Artificial Sequence; identical to SEQ ID NO: 120194
  derived and/or modified sequence opt2 from neuraminidase__InfluenzaB__AGZ59836

SEQ ID NO: 121413 - RNA, 1401 nt, Artificial Sequence; identical to SEQ ID NO: 120883
  derived and/or modified sequence opt2 from neuraminidase__InfluenzaB__AGZ59847

SEQ ID NO: 121414 - RNA, 1401 nt, Artificial Sequence
  derived and/or modified sequence opt2 from neuraminidase__InfluenzaB__AGZ59858
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcaagcgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121415 - RNA, 1401 nt, Artificial Sequence
  derived and/or modified sequence opt2 from neuraminidase__InfluenzaB__AGZ59869
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggccguccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121416 - RNA, 1401 nt, Artificial Sequence; identical to SEQ ID NO: 120912
  derived and/or modified sequence opt2 from neuraminidase__InfluenzaB__AGZ59880

SEQ ID NO: 121417 - RNA, 1401 nt, Artificial Sequence; identical to SEQ ID NO: 121356
  derived and/or modified sequence opt2 from neuraminidase__InfluenzaB__AGZ59891

SEQ ID NO: 121418 - RNA, 1401 nt, Artificial Sequence; identical to SEQ ID NO: 120473
  derived and/or modified sequence opt2 from neuraminidase__InfluenzaB__AGZ59902

SEQ ID NO: 121419 - RNA, 1401 nt, Artificial Sequence; identical to SEQ ID NO: 120473
  derived and/or modified sequence opt2 from neuraminidase__InfluenzaB__AGZ59913

SEQ ID NO: 121420 - RNA, 1401 nt, Artificial Sequence; identical to SEQ ID NO: 120473
  derived and/or modified sequence opt2 from neuraminidase__InfluenzaB__AGZ59924

SEQ ID NO: 121421 - RNA, 1401 nt, Artificial Sequence; identical to SEQ ID NO: 120473
  derived and/or modified sequence opt2 from neuraminidase__InfluenzaB__AGZ59935

SEQ ID NO: 121422 - RNA, 1401 nt, Artificial Sequence; identical to SEQ ID NO: 120473
  derived and/or modified sequence opt2 from neuraminidase__InfluenzaB__AGZ59946

SEQ ID NO: 121423 - RNA, 1401 nt, Artificial Sequence
  derived and/or modified sequence opt2 from neuraminidase__InfluenzaB__AGZ59957
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaagggcaccuggcacuccgccgccaccgccaucuacugccucaugggcuccggccagcuccucugggacaccgucaccggcgucgacauggcccucuga

SEQ ID NO: 121424 - RNA, 1401 nt, Artificial Sequence; identical to SEQ ID NO: 120473
  derived and/or modified sequence opt2 from neuraminidase__InfluenzaB__AGZ59969

SEQ ID NO: 121425 - RNA, 1401 nt, Artificial Sequence; identical to SEQ ID NO: 120473
  derived and/or modified sequence opt2 from neuraminidase__InfluenzaB__AGZ59980

SEQ ID NO: 121426 - RNA, 1401 nt, Artificial Sequence; identical to SEQ ID NO: 120473
  derived and/or modified sequence opt2 from neuraminidase__InfluenzaB__AGZ59991

SEQ ID NO: 121427 - RNA, 1401 nt, Artificial Sequence; identical to SEQ ID NO: 120473
  derived and/or modified sequence opt2 from neuraminidase__InfluenzaB__AGZ60003

SEQ ID NO: 121428 - RNA, 1401 nt, Artificial Sequence
  derived and/or modified sequence opt2 from neuraminidase__InfluenzaB__AGZ60014
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgaggccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccagaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121429 - RNA, 1401 nt, Artificial Sequence; identical to SEQ ID NO: 120407
  derived and/or modified sequence opt2 from neuraminidase__InfluenzaB__AGZ60025

SEQ ID NO: 121430 - RNA, 1401 nt, Artificial Sequence
  derived and/or modified sequence opt2 from neuraminidase__InfluenzaB__AGZ60037
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgaguccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacaucgcccucuga

SEQ ID NO: 121431 - RNA, 1401 nt, Artificial Sequence; identical to SEQ ID NO: 120643
  derived and/or modified sequence opt2 from neuraminidase__InfluenzaB__AGZ60048

SEQ ID NO: 121432 - RNA, 1401 nt, Artificial Sequence; identical to SEQ ID NO: 120643
  derived and/or modified sequence opt2 from neuraminidase__InfluenzaB__AGZ60059

SEQ ID NO: 121433 - RNA, 1401 nt, Artificial Sequence
  derived and/or modified sequence opt2 from neuraminidase__InfluenzaB__AGZ60070
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugccccucgacugcgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgcccacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccaacaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgucuucuccggcgucaugaucuccgucgaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 121434 - RNA, 1401 nt, Artificial Sequence; identical to SEQ ID NO: 120139
  derived and/or modified sequence opt2 from neuraminidase__InfluenzaB__AGZ60081

SEQ ID NO: 121435 - RNA, 1401 nt, Artificial Sequence; identical to SEQ ID NO: 120659
  derived and/or modified sequence opt2 from neuraminidase__InfluenzaB__AGZ60092

SEQ ID NO: 121436 - RNA, 1401 nt, Artificial Sequence; identical to SEQ ID NO: 121282
  derived and/or modified sequence opt2 from neuraminidase__InfluenzaB__AGZ60103

SEQ ID NO: 121437 - RNA, 1401 nt, Artificial Sequence; identical to SEQ ID NO: 120300
  derived and/or modified sequence opt2 from neuraminidase__InfluenzaB__AGZ60135

SEQ ID NO: 121438 - RNA, 1401 nt, Artificial Sequence; identical to SEQ ID NO: 120472
  derived and/or modified sequence opt2 from neuraminidase__InfluenzaB__AGZ60154

SEQ ID NO: 121439 - RNA, 1401 nt, Artificial Sequence
  derived and/or modified sequence opt2 from neuraminidase__InfluenzaB__AGZ60164
augcuccccuccaccacccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucaacccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121440 - RNA, 1401 nt, Artificial Sequence; identical to SEQ ID NO: 121352
  derived and/or modified sequence opt2 from neuraminidase__InfluenzaB__AGZ60176

SEQ ID NO: 121441 - RNA, 1401 nt, Artificial Sequence; identical to SEQ ID NO: 120329
  derived and/or modified sequence opt2 from neuraminidase__InfluenzaB__AGZ60187

SEQ ID NO: 121442 - RNA, 1401 nt, Artificial Sequence; identical to SEQ ID NO: 120329
  derived and/or modified sequence opt2 from neuraminidase__InfluenzaB__AGZ60198

SEQ ID NO: 121443 - RNA, 1401 nt, Artificial Sequence; identical to SEQ ID NO: 120329
  derived and/or modified sequence opt2 from neuraminidase__InfluenzaB__AGZ60210

SEQ ID NO: 121444 - RNA, 1401 nt, Artificial Sequence
  derived and/or modified sequence opt2 from neuraminidase__InfluenzaB__AGZ60221
augcuccccaccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121445 - RNA, 1401 nt, Artificial Sequence
  derived and/or modified sequence opt2 from neuraminidase__InfluenzaB__AGZ60272
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccaagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121446 - RNA, 1398 nt, Artificial Sequence
  derived and/or modified sequence opt2 from neuraminidase__InfluenzaB__AHL91182
augcuccccuccaccauccagacccucacccucuuccucaccuccggcggcguccuccucucccucuacgucuccgcccuccucuccuaccuccucuacuccgacauccuccucaaguucucccccaagaucaucgcccccaccaugucccucgacugcgccaacgccuccaacguccaggccgucaaccacuccgccaccaaggagaugaaguuccucccccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcgucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagcgcaccuggcacuccgccgccaccgccaucuacugccucaugggcuccggccagcuccucugggacaccgucaccggcgucgacauggcccucuga

SEQ ID NO: 121447 - RNA, 1398 nt, Artificial Sequence
  derived and/or modified sequence opt2 from neuraminidase__InfluenzaB__AHL91193
augcuccccuccaccauccagacccucacccucuuccucaccuccggcggcguccuccucucccucuacgucuccgcccuccucuccuaccuccucuacuccgacauccuccucaaguucucccccaagaucaucgcccccaccaugucccucgacugcgccaacgccuccaacguccaggccgucaaccacuccgccaccaaggagaugaaguuccuccccuccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcgucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagcgcaccuggcacuccgccgccaccgccaucuacugccucaugggcuccggccagcuccucugggacaccgucaccggcgucgacauggcccucuga

SEQ ID NO: 121448 - RNA, 1398 nt, Artificial Sequence
  derived and/or modified sequence opt2 from neuraminidase__InfluenzaB__AHL91204
augcuccccuccaccauccagacccucacccucuuccucaccuccggcggcguccuccucucccucuacgucuccgcccuccucuccuaccuccucuacuccgacguccuccucaaguucucccccaagaucaucgcccccaccaugucccucgacugcgccaacgccuccaacguccaggccgucaaccacuccgccaccgaggagaugaccuuccuccuccccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacaucuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccacggcggcaucaagggcggcuucguccaccagcgcauggccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 121449 - RNA, 1398 nt, Artificial Sequence
  derived and/or modified sequence opt2 from neuraminidase__InfluenzaB__AHL91215
augcuccccuccaccauccagacccucacccucuuccucaccuccggcggcguccuccucucccucuacgucuccacccuccucuccuaccuccucuacuccgacauccuccucaaguucucccccaagaucaucgcccccaccaccucccucgacugcgccaacgccuccaacguccaggccgucaaccacuccgccaccaaggagaugaaguuccuccccaccgagcccgaguggaccuacccccgccucuccugccagggcuccaccuuccagaaggcccuccucaucuccccccaccgcuucggcgaggccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaaccucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcgucaagggcggcuucguccaccagcgcaugaccuccaagaucggccgcugguacucccgcaccauguccaagaccaagcgcaugggcauggagcucuacgucaaguacgacggcgaccccuggaccgacuccgacgcccucgcccccuccggcgucauggucuccauggaggagcccggcugguacuccuucggcuucgagaucaaggacaagaagugcgacguccccugcaucggcaucgagaugguccacgacggcggcaagcgcaccuggcacuccgccgccaccgccaucuacugccucaugggcuccggccagcuccucugggacaccgucaccggcgucgacauggcccucuga

SEQ ID NO: 121450 - RNA, 1401 nt, Artificial Sequence; identical to SEQ ID NO: 120221
  derived and/or modified sequence opt2 from neuraminidase__InfluenzaB__AHL91226

SEQ ID NO: 121451 - RNA, 1401 nt, Artificial Sequence; identical to SEQ ID NO: 120222
  derived and/or modified sequence opt2 from neuraminidase__InfluenzaB__AHL91237

SEQ ID NO: 121452 - RNA, 1401 nt, Artificial Sequence; identical to SEQ ID NO: 120222
  derived and/or modified sequence opt2 from neuraminidase__InfluenzaB__AHL91248

SEQ ID NO: 121453 - RNA, 1401 nt, Artificial Sequence; identical to SEQ ID NO: 120221
  derived and/or modified sequence opt2 from neuraminidase__InfluenzaB__AHL91259

SEQ ID NO: 121454 - RNA, 1401 nt, Artificial Sequence; identical to SEQ ID NO: 120221
  derived and/or modified sequence opt2 from neuraminidase__InfluenzaB__AHL91270

SEQ ID NO: 121455 - RNA, 1398 nt, Artificial Sequence; identical to SEQ ID NO: 120193
  derived and/or modified sequence opt2 from neuraminidase__InfluenzaB__AHL91281

SEQ ID NO: 121456 - RNA, 1401 nt, Artificial Sequence
  derived and/or modified sequence opt2 from neuraminidase__InfluenzaB__AHL91303
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucaacgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagacccgccgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgacauggcccucuga

SEQ ID NO: 121457 - RNA, 1401 nt, Artificial Sequence; identical to SEQ ID NO: 120222
  derived and/or modified sequence opt2 from neuraminidase__InfluenzaB__AHL91314

SEQ ID NO: 121458 - RNA, 1401 nt, Artificial Sequence; identical to SEQ ID NO: 120222
  derived and/or modified sequence opt2 from neuraminidase__InfluenzaB__AHL91325

SEQ ID NO: 121459 - RNA, 1401 nt, Artificial Sequence
  derived and/or modified sequence opt2 from neuraminidase__InfluenzaB__AHL91347
augcuccccuccaccauccagacccucacccucuuccucaccuccggcggcguccuccucucccucuacgucuccgccucccucuccuaccuccucuacuccgacguccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucgucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgaggacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121460 - RNA, 1401 nt, Artificial Sequence; identical to SEQ ID NO: 121459
  derived and/or modified sequence opt2 from neuraminidase__InfluenzaB__AHL91358

SEQ ID NO: 121461 - RNA, 1401 nt, Artificial Sequence; identical to SEQ ID NO: 120197
  derived and/or modified sequence opt2 from neuraminidase__InfluenzaB__AHL91369

SEQ ID NO: 121462 - RNA, 1401 nt, Artificial Sequence; identical to SEQ ID NO: 120197
  derived and/or modified sequence opt2 from neuraminidase__InfluenzaB__AHL91380

SEQ ID NO: 121463 - RNA, 1401 nt, Artificial Sequence
  derived and/or modified sequence opt2 from neuraminidase__InfluenzaB__AHL91391
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucaacugcgccaacgccuccaacguccaggccgucaaccgcuccgccaccaagggcgucacccucccccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaucgacuccgacgcccucacccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121464 - RNA, 1401 nt, Artificial Sequence
  derived and/or modified sequence opt2 from neuraminidase__InfluenzaB__AHL91413
augcuccccuccaccauccagacccucacccucuuccucaccuccggcggcguccuccucucccucuacgucuccgccucccucuccuaccuccucuacuccgacauccuccucaaguucacccccaccgagaucaccgcccccaccaugccccucgacugcgccaacgccuccaacguccaggccgucaaccucuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121465 - RNA, 1401 nt, Artificial Sequence
  derived and/or modified sequence opt2 from neuraminidase__InfluenzaB__AHL91446
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcaugacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcggcaagggcuccggcggcaucaagggcggcuucguccaccagcgcauggaguccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaaggagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121466 - RNA, 1401 nt, Artificial Sequence
  derived and/or modified sequence opt2 from neuraminidase__InfluenzaB__AHL91457
augcuccccuccaccauccagacccucacccucuuccucaccuccggcggcguccuccucucccucuacgucuccgccucccucuccuaccuccucuacuccgacauccuccucaaguucucccccaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacacccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121467 - RNA, 1401 nt, Artificial Sequence
  derived and/or modified sequence opt2 from neuraminidase__InfluenzaB__AHL91468
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccgucggcgagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121468 - RNA, 1401 nt, Artificial Sequence
  derived and/or modified sequence opt2 from neuraminidase__InfluenzaB__AHL91479
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugcccuccgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121469 - RNA, 1401 nt, Artificial Sequence
  derived and/or modified sequence opt2 from neuraminidase__InfluenzaB__AHL91501
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcaugacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcggcaagggcuccggcggcaucaagggcggcuucguccaccagcgcauggaguccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121470 - RNA, 1401 nt, Artificial Sequence
  derived and/or modified sequence opt2 from neuraminidase__InfluenzaB__AHL91512
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaucuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121471 - RNA, 1401 nt, Artificial Sequence
  derived and/or modified sequence opt2 from neuraminidase__InfluenzaB__AHL91523
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121472 - RNA, 1401 nt, Artificial Sequence; identical to SEQ ID NO: 121469
  derived and/or modified sequence opt2 from neuraminidase__InfluenzaB__AHL91534

SEQ ID NO: 121473 - RNA, 1401 nt, Artificial Sequence
  derived and/or modified sequence opt2 from neuraminidase__InfluenzaB__AHL91545
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcaugaccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaagggcaccuggcacuccgccgccaccgccaucuacugccucaugggcuccggccagcuccucugggacaccgucaccggcgucgacauggcccucuga

SEQ ID NO: 121474 - RNA, 1401 nt, Artificial Sequence; identical to SEQ ID NO: 121469
  derived and/or modified sequence opt2 from neuraminidase__InfluenzaB__AHL91556

SEQ ID NO: 121475 - RNA, 1401 nt, Artificial Sequence; identical to SEQ ID NO: 121469
  derived and/or modified sequence opt2 from neuraminidase__InfluenzaB__AHL91578

SEQ ID NO: 121476 - RNA, 1401 nt, Artificial Sequence; identical to SEQ ID NO: 120397
  derived and/or modified sequence opt2 from neuraminidase__InfluenzaB__AHL91589

SEQ ID NO: 121477 - RNA, 1401 nt, Artificial Sequence
  derived and/or modified sequence opt2 from neuraminidase__InfluenzaB__AHL91600
augcuccccuccaccauccagacccucacccucuuccucaccaccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121478 - RNA, 1401 nt, Artificial Sequence; identical to SEQ ID NO: 121477
  derived and/or modified sequence opt2 from neuraminidase__InfluenzaB__AHL91611

SEQ ID NO: 121479 - RNA, 1401 nt, Artificial Sequence; identical to SEQ ID NO: 121469
  derived and/or modified sequence opt2 from neuraminidase__InfluenzaB__AHL91622

SEQ ID NO: 121480 - RNA, 1401 nt, Artificial Sequence; identical to SEQ ID NO: 121470
  derived and/or modified sequence opt2 from neuraminidase__InfluenzaB__AHL91633

SEQ ID NO: 121481 - RNA, 1401 nt, Artificial Sequence; identical to SEQ ID NO: 121470
  derived and/or modified sequence opt2 from neuraminidase__InfluenzaB__AHL91644

SEQ ID NO: 121482 - RNA, 1401 nt, Artificial Sequence
  derived and/or modified sequence opt2 from neuraminidase__InfluenzaB__AHL91655
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaaggaggucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121483 - RNA, 1401 nt, Artificial Sequence; identical to SEQ ID NO: 121469
  derived and/or modified sequence opt2 from neuraminidase__InfluenzaB__AHL91666

SEQ ID NO: 121484 - RNA, 1401 nt, Artificial Sequence; identical to SEQ ID NO: 121470
  derived and/or modified sequence opt2 from neuraminidase__InfluenzaB__AHL91677

SEQ ID NO: 121485 - RNA, 1401 nt, Artificial Sequence; identical to SEQ ID NO: 121471
  derived and/or modified sequence opt2 from neuraminidase__InfluenzaB__AHL91688

SEQ ID NO: 121486 - RNA, 1401 nt, Artificial Sequence; identical to SEQ ID NO: 120199
  derived and/or modified sequence opt2 from neuraminidase__InfluenzaB__AHL91699

SEQ ID NO: 121487 - RNA, 1401 nt, Artificial Sequence
  derived and/or modified sequence opt2 from neuraminidase__InfluenzaB__AHL91710
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121488 - RNA, 1401 nt, Artificial Sequence; identical to SEQ ID NO: 120126
  derived and/or modified sequence opt2 from neuraminidase__InfluenzaB__AHL91721

SEQ ID NO: 121489 - RNA, 1401 nt, Artificial Sequence; identical to SEQ ID NO: 120194
  derived and/or modified sequence opt2 from neuraminidase__InfluenzaB__AHL91732

SEQ ID NO: 121490 - RNA, 1401 nt, Artificial Sequence; identical to SEQ ID NO: 120126
  derived and/or modified sequence opt2 from neuraminidase__InfluenzaB__AHL91743

SEQ ID NO: 121491 - RNA, 1401 nt, Artificial Sequence
  derived and/or modified sequence opt2 from neuraminidase__InfluenzaB__AHL91754
augcuccccuccaccauccagacccucacccuccuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121492 - RNA, 1401 nt, Artificial Sequence; identical to SEQ ID NO: 120126
  derived and/or modified sequence opt2 from neuraminidase__InfluenzaB__AHL91765

SEQ ID NO: 121493 - RNA, 1401 nt, Artificial Sequence
  derived and/or modified sequence opt2 from neuraminidase__InfluenzaB__AHL91776
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaccuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121494 - RNA, 1401 nt, Artificial Sequence; identical to SEQ ID NO: 121493
  derived and/or modified sequence opt2 from neuraminidase__InfluenzaB__AHL91787

SEQ ID NO: 121495 - RNA, 1401 nt, Artificial Sequence; identical to SEQ ID NO: 121493
  derived and/or modified sequence opt2 from neuraminidase__InfluenzaB__AHL91798

SEQ ID NO: 121496 - RNA, 1401 nt, Artificial Sequence; identical to SEQ ID NO: 120130
  derived and/or modified sequence opt2 from neuraminidase__InfluenzaB__AHL91809

SEQ ID NO: 121497 - RNA, 1401 nt, Artificial Sequence
  derived and/or modified sequence opt2 from neuraminidase__InfluenzaB__AHL91820
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121498 - RNA, 1401 nt, Artificial Sequence
  derived and/or modified sequence opt2 from neuraminidase__InfluenzaB__AHL91831
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggcuccggcggcaucaagggcggcuucguccaccagcgcaugaccuccaagaucggccgcugguacucccgcaccauguccaagaccgagcgcaugggcaugggccucuacgucaaguacgacggcgaccccugggccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121499 - RNA, 1401 nt, Artificial Sequence; identical to SEQ ID NO: 120643
  derived and/or modified sequence opt2 from neuraminidase__InfluenzaB__AHL91842

SEQ ID NO: 121500 - RNA, 1401 nt, Artificial Sequence
  derived and/or modified sequence opt2 from neuraminidase__InfluenzaB__AHL91853
augcuccccuccaccauccagacccucacccucuuccucaccuccggcggcguccuccucucccucuacgucuccgccucccucuccuaccuccucuacuccgacauccuccucaaguucuccaccaccgagaucaccgcccccaccaugcccuccgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgacgcccucgcccucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121501 - RNA, 1401 nt, Artificial Sequence; identical to SEQ ID NO: 120641
  derived and/or modified sequence opt2 from neuraminidase__InfluenzaB__AHL91864

SEQ ID NO: 121502 - RNA, 1401 nt, Artificial Sequence; identical to SEQ ID NO: 120641
  derived and/or modified sequence opt2 from neuraminidase__InfluenzaB__AHL91875

SEQ ID NO: 121503 - RNA, 1401 nt, Artificial Sequence; identical to SEQ ID NO: 120398
  derived and/or modified sequence opt2 from neuraminidase__InfluenzaB__AHL91886

SEQ ID NO: 121504 - RNA, 1401 nt, Artificial Sequence; identical to SEQ ID NO: 120139
  derived and/or modified sequence opt2 from neuraminidase__InfluenzaB__AHL91897

SEQ ID NO: 121505 - RNA, 1401 nt, Artificial Sequence; identical to SEQ ID NO: 120139
  derived and/or modified sequence opt2 from neuraminidase__InfluenzaB__AHL91908

SEQ ID NO: 121506 - RNA, 1401 nt, Artificial Sequence
  derived and/or modified sequence opt2 from neuraminidase__InfluenzaB__AHL91919
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121507 - RNA, 1401 nt, Artificial Sequence; identical to SEQ ID NO: 121201
  derived and/or modified sequence opt2 from neuraminidase__InfluenzaB__AHL91930

SEQ ID NO: 121508 - RNA, 1401 nt, Artificial Sequence; identical to SEQ ID NO: 120139
  derived and/or modified sequence opt2 from neuraminidase__InfluenzaB__AHL91941

SEQ ID NO: 121509 - RNA, 1401 nt, Artificial Sequence; identical to SEQ ID NO: 120139
  derived and/or modified sequence opt2 from neuraminidase__InfluenzaB__AHL91952

SEQ ID NO: 121510 - RNA, 1401 nt, Artificial Sequence; identical to SEQ ID NO: 120182
  derived and/or modified sequence opt2 from neuraminidase__InfluenzaB__AHL91963

SEQ ID NO: 121511 - RNA, 1401 nt, Artificial Sequence
  derived and/or modified sequence opt2 from neuraminidase__InfluenzaB__AHL91974
augcuccccuccaccauccagacccucacccucuuccucaccuccggcggcguccuccucucccucuacgucuccgccucccucuccuaccuccucuacuccgacauccuccucaaguucucccccaccgagaucaccacccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121512 - RNA, 1401 nt, Artificial Sequence; identical to SEQ ID NO: 120182
  derived and/or modified sequence opt2 from neuraminidase__InfluenzaB__AHL91985

SEQ ID NO: 121513 - RNA, 1401 nt, Artificial Sequence; identical to SEQ ID NO: 120139
  derived and/or modified sequence opt2 from neuraminidase__InfluenzaB__AHL91995

SEQ ID NO: 121514 - RNA, 1401 nt, Artificial Sequence
  derived and/or modified sequence opt2 from neuraminidase__InfluenzaB__AHL92006
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcgucgagaugguccacgacggcggcaaggagaccuggcacuccgccgccaccgccaucuacugccucaugggcuccggccagcuccucugggacaccgucaccggcgucgacauggcccucuga

SEQ ID NO: 121515 - RNA, 1401 nt, Artificial Sequence; identical to SEQ ID NO: 120147
  derived and/or modified sequence opt2 from neuraminidase__InfluenzaB__AHL92017

SEQ ID NO: 121516 - RNA, 1401 nt, Artificial Sequence; identical to SEQ ID NO: 120147
  derived and/or modified sequence opt2 from neuraminidase__InfluenzaB__AHL92028

SEQ ID NO: 121517 - RNA, 1401 nt, Artificial Sequence
  derived and/or modified sequence opt2 from neuraminidase__InfluenzaB__AHL92039
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaucuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacaacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121518 - RNA, 1401 nt, Artificial Sequence; identical to SEQ ID NO: 120147
  derived and/or modified sequence opt2 from neuraminidase__InfluenzaB__AHL92050

SEQ ID NO: 121519 - RNA, 1401 nt, Artificial Sequence
  derived and/or modified sequence opt2 from neuraminidase__InfluenzaB__AHL92061
augcuccccuccaccacccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121520 - RNA, 1401 nt, Artificial Sequence
  derived and/or modified sequence opt2 from neuraminidase__InfluenzaB__AHL92072
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121521 - RNA, 1401 nt, Artificial Sequence; identical to SEQ ID NO: 121520
  derived and/or modified sequence opt2 from neuraminidase__InfluenzaB__AHL92083

SEQ ID NO: 121522 - RNA, 1401 nt, Artificial Sequence; identical to SEQ ID NO: 121520
  derived and/or modified sequence opt2 from neuraminidase__InfluenzaB__AHL92094

SEQ ID NO: 121523 - RNA, 1401 nt, Artificial Sequence
  derived and/or modified sequence opt2 from neuraminidase__InfluenzaB__AHL92105
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcggcggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucucccucaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121524 - RNA, 1401 nt, Artificial Sequence; identical to SEQ ID NO: 120300
  derived and/or modified sequence opt2 from neuraminidase__InfluenzaB__AHL92116

SEQ ID NO: 121525 - RNA, 1401 nt, Artificial Sequence; identical to SEQ ID NO: 121520
  derived and/or modified sequence opt2 from neuraminidase__InfluenzaB__AHL92127

SEQ ID NO: 121526 - RNA, 1401 nt, Artificial Sequence; identical to SEQ ID NO: 121520
  derived and/or modified sequence opt2 from neuraminidase__InfluenzaB__AHL92138

SEQ ID NO: 121527 - RNA, 1401 nt, Artificial Sequence; identical to SEQ ID NO: 121520
  derived and/or modified sequence opt2 from neuraminidase__InfluenzaB__AHL92149

SEQ ID NO: 121528 - RNA, 1401 nt, Artificial Sequence
  derived and/or modified sequence opt2 from neuraminidase__InfluenzaB__AHL92171
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucgucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121529 - RNA, 1401 nt, Artificial Sequence
  derived and/or modified sequence opt2 from neuraminidase__InfluenzaB__AHL92182
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgagugggccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacuccggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121530 - RNA, 1401 nt, Artificial Sequence; identical to SEQ ID NO: 121529
  derived and/or modified sequence opt2 from neuraminidase__InfluenzaB__AHL92193

SEQ ID NO: 121531 - RNA, 1401 nt, Artificial Sequence; identical to SEQ ID NO: 120300
  derived and/or modified sequence opt2 from neuraminidase__InfluenzaB__AHL92204

SEQ ID NO: 121532 - RNA, 1401 nt, Artificial Sequence
  derived and/or modified sequence opt2 from neuraminidase__InfluenzaB__AHL92215
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaagggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121533 - RNA, 1401 nt, Artificial Sequence; identical to SEQ ID NO: 121520
  derived and/or modified sequence opt2 from neuraminidase__InfluenzaB__AHL92226

SEQ ID NO: 121534 - RNA, 1401 nt, Artificial Sequence; identical to SEQ ID NO: 120300
  derived and/or modified sequence opt2 from neuraminidase__InfluenzaB__AHL92237

SEQ ID NO: 121535 - RNA, 1401 nt, Artificial Sequence; identical to SEQ ID NO: 121520
  derived and/or modified sequence opt2 from neuraminidase__InfluenzaB__AHL92248

SEQ ID NO: 121536 - RNA, 1401 nt, Artificial Sequence
  derived and/or modified sequence opt2 from neuraminidase__InfluenzaB__AHL92259
augcuccccuccaccauccagacccucacccucuuccucaccuccggcggcguccuccucucccucuacgucuccgccucccucuccuaccuccucuacuccgacauccuccucaaguucucccccaccgagaucaccgccuccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcaugaccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121537 - RNA, 1401 nt, Artificial Sequence; identical to SEQ ID NO: 121520
  derived and/or modified sequence opt2 from neuraminidase__InfluenzaB__AHL92270

SEQ ID NO: 121538 - RNA, 1401 nt, Artificial Sequence
  derived and/or modified sequence opt2 from neuraminidase__InfluenzaB__AHL92281
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgccaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121539 - RNA, 1401 nt, Artificial Sequence
  derived and/or modified sequence opt2 from neuraminidase__InfluenzaB__AHL92303
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcaacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121540 - RNA, 1401 nt, Artificial Sequence
  derived and/or modified sequence opt2 from neuraminidase__InfluenzaB__AHL92314
augcuccccuccaccauccagacccucacccucuuccucaccuccggcggcguccuccucucccucuacgucuccgccucccucuccuaccuccucuacuccgacauccuccucaaguucucccagaccaagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggacgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121541 - RNA, 1401 nt, Artificial Sequence
  derived and/or modified sequence opt2 from neuraminidase__InfluenzaB__AHL92325
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccaugggcgagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121542 - RNA, 1401 nt, Artificial Sequence; identical to SEQ ID NO: 120300
  derived and/or modified sequence opt2 from neuraminidase__InfluenzaB__AHL92336

SEQ ID NO: 121543 - RNA, 1401 nt, Artificial Sequence
  derived and/or modified sequence opt2 from neuraminidase__InfluenzaB__AHL92358
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacgucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121544 - RNA, 1401 nt, Artificial Sequence; identical to SEQ ID NO: 121543
  derived and/or modified sequence opt2 from neuraminidase__InfluenzaB__AHL92369

SEQ ID NO: 121545 - RNA, 1401 nt, Artificial Sequence
  derived and/or modified sequence opt2 from neuraminidase__InfluenzaB__AHL92380
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaagcuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121546 - RNA, 1401 nt, Artificial Sequence
  derived and/or modified sequence opt2 from neuraminidase__InfluenzaB__AHL92391
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcuccaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121547 - RNA, 1401 nt, Artificial Sequence; identical to SEQ ID NO: 120329
  derived and/or modified sequence opt2 from neuraminidase__InfluenzaB__AHL92402

SEQ ID NO: 121548 - RNA, 1401 nt, Artificial Sequence; identical to SEQ ID NO: 120329
  derived and/or modified sequence opt2 from neuraminidase__InfluenzaB__AHL92413

SEQ ID NO: 121549 - RNA, 1401 nt, Artificial Sequence; identical to SEQ ID NO: 120329
  derived and/or modified sequence opt2 from neuraminidase__InfluenzaB__AHL92424

SEQ ID NO: 121550 - RNA, 1401 nt, Artificial Sequence
  derived and/or modified sequence opt2 from neuraminidase__InfluenzaB__AHL92435
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugaucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121551 - RNA, 1401 nt, Artificial Sequence; identical to SEQ ID NO: 120329
  derived and/or modified sequence opt2 from neuraminidase__InfluenzaB__AHL92446

SEQ ID NO: 121552 - RNA, 1401 nt, Artificial Sequence; identical to SEQ ID NO: 120329
  derived and/or modified sequence opt2 from neuraminidase__InfluenzaB__AHL92457

SEQ ID NO: 121553 - RNA, 1401 nt, Artificial Sequence; identical to SEQ ID NO: 120329
  derived and/or modified sequence opt2 from neuraminidase__InfluenzaB__AHL92468

SEQ ID NO: 121554 - RNA, 1401 nt, Artificial Sequence; identical to SEQ ID NO: 120329
  derived and/or modified sequence opt2 from neuraminidase__InfluenzaB__AHL92479

SEQ ID NO: 121555 - RNA, 1401 nt, Artificial Sequence; identical to SEQ ID NO: 120300
  derived and/or modified sequence opt2 from neuraminidase__InfluenzaB__AHL92490

SEQ ID NO: 121556 - RNA, 1401 nt, Artificial Sequence; identical to SEQ ID NO: 120329
  derived and/or modified sequence opt2 from neuraminidase__InfluenzaB__AHL92501

SEQ ID NO: 121557 - RNA, 1401 nt, Artificial Sequence
  derived and/or modified sequence opt2 from neuraminidase__InfluenzaB__AHL92512
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggucgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121558 - RNA, 1401 nt, Artificial Sequence; identical to SEQ ID NO: 120329
  derived and/or modified sequence opt2 from neuraminidase__InfluenzaB__AHL92523

SEQ ID NO: 121559 - RNA, 1401 nt, Artificial Sequence; identical to SEQ ID NO: 120329
  derived and/or modified sequence opt2 from neuraminidase__InfluenzaB__AHL92534

SEQ ID NO: 121560 - RNA, 1401 nt, Artificial Sequence; identical to SEQ ID NO: 120300
  derived and/or modified sequence opt2 from neuraminidase__InfluenzaB__AHL92545

SEQ ID NO: 121561 - RNA, 1401 nt, Artificial Sequence; identical to SEQ ID NO: 120329
  derived and/or modified sequence opt2 from neuraminidase__InfluenzaB__AHL92556

SEQ ID NO: 121562 - RNA, 1401 nt, Artificial Sequence; identical to SEQ ID NO: 120329
  derived and/or modified sequence opt2 from neuraminidase__InfluenzaB__AHL92567

SEQ ID NO: 121563 - RNA, 1401 nt, Artificial Sequence; identical to SEQ ID NO: 120329
  derived and/or modified sequence opt2 from neuraminidase__InfluenzaB__AHL92578

SEQ ID NO: 121564 - RNA, 1401 nt, Artificial Sequence; identical to SEQ ID NO: 120300
  derived and/or modified sequence opt2 from neuraminidase__InfluenzaB__AHL92589

SEQ ID NO: 121565 - RNA, 1401 nt, Artificial Sequence; identical to SEQ ID NO: 120329
  derived and/or modified sequence opt2 from neuraminidase__InfluenzaB__AHL92600

SEQ ID NO: 121566 - RNA, 1401 nt, Artificial Sequence; identical to SEQ ID NO: 121356
  derived and/or modified sequence opt2 from neuraminidase__InfluenzaB__AHL92611

SEQ ID NO: 121567 - RNA, 1401 nt, Artificial Sequence
  derived and/or modified sequence opt2 from neuraminidase__InfluenzaB__AHL92622
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121568 - RNA, 1401 nt, Artificial Sequence
  derived and/or modified sequence opt2 from neuraminidase__InfluenzaB__AHL92633
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaucgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121569 - RNA, 1401 nt, Artificial Sequence; identical to SEQ ID NO: 120300
  derived and/or modified sequence opt2 from neuraminidase__InfluenzaB__AHL92644

SEQ ID NO: 121570 - RNA, 1401 nt, Artificial Sequence; identical to SEQ ID NO: 120300
  derived and/or modified sequence opt2 from neuraminidase__InfluenzaB__AHL92655

SEQ ID NO: 121571 - RNA, 1401 nt, Artificial Sequence; identical to SEQ ID NO: 120329
  derived and/or modified sequence opt2 from neuraminidase__InfluenzaB__AHL92666

SEQ ID NO: 121572 - RNA, 1401 nt, Artificial Sequence; identical to SEQ ID NO: 120329
  derived and/or modified sequence opt2 from neuraminidase__InfluenzaB__AHL92677

SEQ ID NO: 121573 - RNA, 1401 nt, Artificial Sequence; identical to SEQ ID NO: 120300
  derived and/or modified sequence opt2 from neuraminidase__InfluenzaB__AHL92688

SEQ ID NO: 121574 - RNA, 1401 nt, Artificial Sequence; identical to SEQ ID NO: 120329
  derived and/or modified sequence opt2 from neuraminidase__InfluenzaB__AHL92699

SEQ ID NO: 121575 - RNA, 1401 nt, Artificial Sequence; identical to SEQ ID NO: 120329
  derived and/or modified sequence opt2 from neuraminidase__InfluenzaB__AHL92710

SEQ ID NO: 121576 - RNA, 1401 nt, Artificial Sequence; identical to SEQ ID NO: 120329
  derived and/or modified sequence opt2 from neuraminidase__InfluenzaB__AHL92721

SEQ ID NO: 121577 - RNA, 1401 nt, Artificial Sequence; identical to SEQ ID NO: 120329
  derived and/or modified sequence opt2 from neuraminidase__InfluenzaB__AHL92732

SEQ ID NO: 121578 - RNA, 1401 nt, Artificial Sequence; identical to SEQ ID NO: 120329
  derived and/or modified sequence opt2 from neuraminidase__InfluenzaB__AHL92743

SEQ ID NO: 121579 - RNA, 1401 nt, Artificial Sequence; identical to SEQ ID NO: 120329
  derived and/or modified sequence opt2 from neuraminidase__InfluenzaB__AHL92754

SEQ ID NO: 121580 - RNA, 1401 nt, Artificial Sequence; identical to SEQ ID NO: 120329
  derived and/or modified sequence opt2 from neuraminidase__InfluenzaB__AHL92765

SEQ ID NO: 121581 - RNA, 1401 nt, Artificial Sequence; identical to SEQ ID NO: 120329
  derived and/or modified sequence opt2 from neuraminidase__InfluenzaB__AHL92776

SEQ ID NO: 121582 - RNA, 1401 nt, Artificial Sequence; identical to SEQ ID NO: 120329
  derived and/or modified sequence opt2 from neuraminidase__InfluenzaB__AHL92787

SEQ ID NO: 121583 - RNA, 1401 nt, Artificial Sequence; identical to SEQ ID NO: 120329
  derived and/or modified sequence opt2 from neuraminidase__InfluenzaB__AHL92798

SEQ ID NO: 121584 - RNA, 1401 nt, Artificial Sequence
  derived and/or modified sequence opt2 from neuraminidase__InfluenzaB__AHL92809
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaucaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121585 - RNA, 1401 nt, Artificial Sequence
  derived and/or modified sequence opt2 from neuraminidase__InfluenzaB__AHL92820
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucaacaugacccucuga

SEQ ID NO: 121586 - RNA, 1401 nt, Artificial Sequence
  derived and/or modified sequence opt2 from neuraminidase__InfluenzaB__AHL92842
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccaccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121587 - RNA, 1401 nt, Artificial Sequence; identical to SEQ ID NO: 120329
  derived and/or modified sequence opt2 from neuraminidase__InfluenzaB__AHL92853

SEQ ID NO: 121588 - RNA, 1401 nt, Artificial Sequence; identical to SEQ ID NO: 120329
  derived and/or modified sequence opt2 from neuraminidase__InfluenzaB__AHL92864

SEQ ID NO: 121589 - RNA, 1401 nt, Artificial Sequence; identical to SEQ ID NO: 120182
  derived and/or modified sequence opt2 from neuraminidase__InfluenzaB__AHL92875

SEQ ID NO: 121590 - RNA, 1401 nt, Artificial Sequence; identical to SEQ ID NO: 120139
  derived and/or modified sequence opt2 from neuraminidase__InfluenzaB__AHL92886

SEQ ID NO: 121591 - RNA, 1401 nt, Artificial Sequence
  derived and/or modified sequence opt2 from neuraminidase__InfluenzaB__AHL92897
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaucccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121592 - RNA, 1401 nt, Artificial Sequence
  derived and/or modified sequence opt2 from neuraminidase__InfluenzaB__AHL92908
augcuccccuccaccauccagacccucacccucuuccucacccucggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccgucuacugccucaugggcuccggccagcuccucugggacaccaucaccggcgucgacauggcccucuga

SEQ ID NO: 121593 - RNA, 1401 nt, Artificial Sequence
  derived and/or modified sequence opt2 from neuraminidase__InfluenzaB__AHL92919
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcaucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121594 - RNA, 1401 nt, Artificial Sequence
  derived and/or modified sequence opt2 from neuraminidase__InfluenzaB__AHL92930
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucgacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121595 - RNA, 1401 nt, Artificial Sequence; identical to SEQ ID NO: 120139
  derived and/or modified sequence opt2 from neuraminidase__InfluenzaB__AHL92941

SEQ ID NO: 121596 - RNA, 1401 nt, Artificial Sequence; identical to SEQ ID NO: 120147
  derived and/or modified sequence opt2 from neuraminidase__InfluenzaB__AHL92952

SEQ ID NO: 121597 - RNA, 1401 nt, Artificial Sequence; identical to SEQ ID NO: 120147
  derived and/or modified sequence opt2 from neuraminidase__InfluenzaB__AHL92963

SEQ ID NO: 121598 - RNA, 1401 nt, Artificial Sequence
  derived and/or modified sequence opt2 from neuraminidase__InfluenzaB__AHL92974
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacaacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121599 - RNA, 1401 nt, Artificial Sequence; identical to SEQ ID NO: 120147
  derived and/or modified sequence opt2 from neuraminidase__InfluenzaB__AHL92985

SEQ ID NO: 121600 - RNA, 1401 nt, Artificial Sequence; identical to SEQ ID NO: 120147
  derived and/or modified sequence opt2 from neuraminidase__InfluenzaB__AHL92996

SEQ ID NO: 121601 - RNA, 1401 nt, Artificial Sequence; identical to SEQ ID NO: 121520
  derived and/or modified sequence opt2 from neuraminidase__InfluenzaB__AHL93008

SEQ ID NO: 121602 - RNA, 1401 nt, Artificial Sequence; identical to SEQ ID NO: 121529
  derived and/or modified sequence opt2 from neuraminidase__InfluenzaB__AHL93019

SEQ ID NO: 121603 - RNA, 1401 nt, Artificial Sequence; identical to SEQ ID NO: 121529
  derived and/or modified sequence opt2 from neuraminidase__InfluenzaB__AHL93030

SEQ ID NO: 121604 - RNA, 1401 nt, Artificial Sequence; identical to SEQ ID NO: 121543
  derived and/or modified sequence opt2 from neuraminidase__InfluenzaB__AHL93041

SEQ ID NO: 121605 - RNA, 1401 nt, Artificial Sequence; identical to SEQ ID NO: 121543
  derived and/or modified sequence opt2 from neuraminidase__InfluenzaB__AHL93052

SEQ ID NO: 121606 - RNA, 1401 nt, Artificial Sequence; identical to SEQ ID NO: 120329
  derived and/or modified sequence opt2 from neuraminidase__InfluenzaB__AHL93063

SEQ ID NO: 121607 - RNA, 1401 nt, Artificial Sequence; identical to SEQ ID NO: 120329
  derived and/or modified sequence opt2 from neuraminidase__InfluenzaB__AHL93074

SEQ ID NO: 121608 - RNA, 1401 nt, Artificial Sequence; identical to SEQ ID NO: 120329
  derived and/or modified sequence opt2 from neuraminidase__InfluenzaB__AHL93085

SEQ ID NO: 121609 - RNA, 1401 nt, Artificial Sequence; identical to SEQ ID NO: 121586
  derived and/or modified sequence opt2 from neuraminidase__InfluenzaB__AHL93096

SEQ ID NO: 121610 - RNA, 1401 nt, Artificial Sequence; identical to SEQ ID NO: 120329
  derived and/or modified sequence opt2 from neuraminidase__InfluenzaB__AHL93107

SEQ ID NO: 121611 - RNA, 1401 nt, Artificial Sequence; identical to SEQ ID NO: 120329
  derived and/or modified sequence opt2 from neuraminidase__InfluenzaB__AHL93118

SEQ ID NO: 121612 - RNA, 1401 nt, Artificial Sequence; identical to SEQ ID NO: 120300
  derived and/or modified sequence opt2 from neuraminidase__InfluenzaB__AHL93129

SEQ ID NO: 121613 - RNA, 1401 nt, Artificial Sequence; identical to SEQ ID NO: 120329
  derived and/or modified sequence opt2 from neuraminidase__InfluenzaB__AHL93140

SEQ ID NO: 121614 - RNA, 1401 nt, Artificial Sequence; identical to SEQ ID NO: 120300
  derived and/or modified sequence opt2 from neuraminidase__InfluenzaB__AHL93151

SEQ ID NO: 121615 - RNA, 1401 nt, Artificial Sequence; identical to SEQ ID NO: 120329
  derived and/or modified sequence opt2 from neuraminidase__InfluenzaB__AHL93162

SEQ ID NO: 121616 - RNA, 1401 nt, Artificial Sequence; identical to SEQ ID NO: 120329
  derived and/or modified sequence opt2 from neuraminidase__InfluenzaB__AHL93173

SEQ ID NO: 121617 - RNA, 1401 nt, Artificial Sequence; identical to SEQ ID NO: 120300
  derived and/or modified sequence opt2 from neuraminidase__InfluenzaB__AHL93184

SEQ ID NO: 121618 - RNA, 1401 nt, Artificial Sequence; identical to SEQ ID NO: 120329
  derived and/or modified sequence opt2 from neuraminidase__InfluenzaB__AHL93195

SEQ ID NO: 121619 - RNA, 1401 nt, Artificial Sequence; identical to SEQ ID NO: 120329
  derived and/or modified sequence opt2 from neuraminidase__InfluenzaB__AHL93206

SEQ ID NO: 121620 - RNA, 1401 nt, Artificial Sequence; identical to SEQ ID NO: 120473
  derived and/or modified sequence opt2 from neuraminidase__InfluenzaB__AHL93217

SEQ ID NO: 121621 - RNA, 1401 nt, Artificial Sequence; identical to SEQ ID NO: 120473
  derived and/or modified sequence opt2 from neuraminidase__InfluenzaB__AHL93228

SEQ ID NO: 121622 - RNA, 1401 nt, Artificial Sequence
  derived and/or modified sequence opt2 from neuraminidase__InfluenzaB__AHL93239
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121623 - RNA, 1401 nt, Artificial Sequence
  derived and/or modified sequence opt2 from neuraminidase__InfluenzaB__AHL93250
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121624 - RNA, 1401 nt, Artificial Sequence; identical to SEQ ID NO: 120473
  derived and/or modified sequence opt2 from neuraminidase__InfluenzaB__AHL93261

SEQ ID NO: 121625 - RNA, 1401 nt, Artificial Sequence; identical to SEQ ID NO: 120473
  derived and/or modified sequence opt2 from neuraminidase__InfluenzaB__AHL93272

SEQ ID NO: 121626 - RNA, 1401 nt, Artificial Sequence; identical to SEQ ID NO: 120473
  derived and/or modified sequence opt2 from neuraminidase__InfluenzaB__AHL93283

SEQ ID NO: 121627 - RNA, 1401 nt, Artificial Sequence; identical to SEQ ID NO: 120473
  derived and/or modified sequence opt2 from neuraminidase__InfluenzaB__AHL93294

SEQ ID NO: 121628 - RNA, 1401 nt, Artificial Sequence
  derived and/or modified sequence opt2 from neuraminidase__InfluenzaB__AHL93305
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucgucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121629 - RNA, 1401 nt, Artificial Sequence; identical to SEQ ID NO: 120473
  derived and/or modified sequence opt2 from neuraminidase__InfluenzaB__AHL93316

SEQ ID NO: 121630 - RNA, 1401 nt, Artificial Sequence
  derived and/or modified sequence opt2 from neuraminidase__InfluenzaB__AHL93338
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacgccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121631 - RNA, 1401 nt, Artificial Sequence
  derived and/or modified sequence opt2 from neuraminidase__InfluenzaB__AHL93349
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccagggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcauggagcucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121632 - RNA, 1401 nt, Artificial Sequence; identical to SEQ ID NO: 120473
  derived and/or modified sequence opt2 from neuraminidase__InfluenzaB__AHL93371

SEQ ID NO: 121633 - RNA, 1401 nt, Artificial Sequence
  derived and/or modified sequence opt2 from neuraminidase__InfluenzaB__AHL93382
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcauggagcucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121634 - RNA, 1401 nt, Artificial Sequence; identical to SEQ ID NO: 120473
  derived and/or modified sequence opt2 from neuraminidase__InfluenzaB__AHL93393

SEQ ID NO: 121635 - RNA, 1401 nt, Artificial Sequence; identical to SEQ ID NO: 120473
  derived and/or modified sequence opt2 from neuraminidase__InfluenzaB__AHL93404

SEQ ID NO: 121636 - RNA, 1401 nt, Artificial Sequence; identical to SEQ ID NO: 120473
  derived and/or modified sequence opt2 from neuraminidase__InfluenzaB__AHL93415

SEQ ID NO: 121637 - RNA, 1401 nt, Artificial Sequence; identical to SEQ ID NO: 120473
  derived and/or modified sequence opt2 from neuraminidase__InfluenzaB__AHL93426

SEQ ID NO: 121638 - RNA, 1401 nt, Artificial Sequence; identical to SEQ ID NO: 120473
  derived and/or modified sequence opt2 from neuraminidase__InfluenzaB__AHL93437

SEQ ID NO: 121639 - RNA, 1401 nt, Artificial Sequence; identical to SEQ ID NO: 121633
  derived and/or modified sequence opt2 from neuraminidase__InfluenzaB__AHL93448

SEQ ID NO: 121640 - RNA, 1404 nt, Artificial Sequence
  derived and/or modified sequence opt2 from neuraminidase__InfluenzaB__AHL93459
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121641 - RNA, 1401 nt, Artificial Sequence
  derived and/or modified sequence opt2 from neuraminidase__InfluenzaB__AHL93470
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121642 - RNA, 1401 nt, Artificial Sequence; identical to SEQ ID NO: 120410
  derived and/or modified sequence opt2 from neuraminidase__InfluenzaB__AHL93481

SEQ ID NO: 121643 - RNA, 1401 nt, Artificial Sequence; identical to SEQ ID NO: 120468
  derived and/or modified sequence opt2 from neuraminidase__InfluenzaB__AHL93492

SEQ ID NO: 121644 - RNA, 1401 nt, Artificial Sequence; identical to SEQ ID NO: 120329
  derived and/or modified sequence opt2 from neuraminidase__InfluenzaB__AHL93503

SEQ ID NO: 121645 - RNA, 1401 nt, Artificial Sequence
  derived and/or modified sequence opt2 from neuraminidase__InfluenzaB__AHL93514
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccaucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggcuccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121646 - RNA, 1401 nt, Artificial Sequence; identical to SEQ ID NO: 120329
  derived and/or modified sequence opt2 from neuraminidase__InfluenzaB__AHL93525

SEQ ID NO: 121647 - RNA, 1401 nt, Artificial Sequence; identical to SEQ ID NO: 120468
  derived and/or modified sequence opt2 from neuraminidase__InfluenzaB__AHL93536

SEQ ID NO: 121648 - RNA, 1401 nt, Artificial Sequence
  derived and/or modified sequence opt2 from neuraminidase__InfluenzaB__AHL93558
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucauccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121649 - RNA, 1401 nt, Artificial Sequence
  derived and/or modified sequence opt2 from neuraminidase__InfluenzaB__AHL93569
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121650 - RNA, 1401 nt, Artificial Sequence; identical to SEQ ID NO: 120468
  derived and/or modified sequence opt2 from neuraminidase__InfluenzaB__AHL93580

SEQ ID NO: 121651 - RNA, 1401 nt, Artificial Sequence; identical to SEQ ID NO: 120468
  derived and/or modified sequence opt2 from neuraminidase__InfluenzaB__AHL93591

SEQ ID NO: 121652 - RNA, 1401 nt, Artificial Sequence
  derived and/or modified sequence opt2 from neuraminidase__InfluenzaB__AHL93613
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121653 - RNA, 1401 nt, Artificial Sequence; identical to SEQ ID NO: 120468
  derived and/or modified sequence opt2 from neuraminidase__InfluenzaB__AHL93624

SEQ ID NO: 121654 - RNA, 1401 nt, Artificial Sequence; identical to SEQ ID NO: 121652
  derived and/or modified sequence opt2 from neuraminidase__InfluenzaB__AHL93635

SEQ ID NO: 121655 - RNA, 1401 nt, Artificial Sequence; identical to SEQ ID NO: 121652
  derived and/or modified sequence opt2 from neuraminidase__InfluenzaB__AHL93646

SEQ ID NO: 121656 - RNA, 1401 nt, Artificial Sequence; identical to SEQ ID NO: 120329
  derived and/or modified sequence opt2 from neuraminidase__InfluenzaB__AHL93657

SEQ ID NO: 121657 - RNA, 1401 nt, Artificial Sequence; identical to SEQ ID NO: 120468
  derived and/or modified sequence opt2 from neuraminidase__InfluenzaB__AHL93668

SEQ ID NO: 121658 - RNA, 1401 nt, Artificial Sequence
  derived and/or modified sequence opt2 from neuraminidase__InfluenzaB__AHL93679
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagauccuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121659 - RNA, 1401 nt, Artificial Sequence; identical to SEQ ID NO: 121652
  derived and/or modified sequence opt2 from neuraminidase__InfluenzaB__AHL93690

SEQ ID NO: 121660 - RNA, 1401 nt, Artificial Sequence; identical to SEQ ID NO: 121652
  derived and/or modified sequence opt2 from neuraminidase__InfluenzaB__AHL93701

SEQ ID NO: 121661 - RNA, 1401 nt, Artificial Sequence; identical to SEQ ID NO: 121652
  derived and/or modified sequence opt2 from neuraminidase__InfluenzaB__AHL93712

SEQ ID NO: 121662 - RNA, 1401 nt, Artificial Sequence
  derived and/or modified sequence opt2 from neuraminidase__InfluenzaB__AHL93723
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaccaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121663 - RNA, 1401 nt, Artificial Sequence; identical to SEQ ID NO: 120468
  derived and/or modified sequence opt2 from neuraminidase__InfluenzaB__AHL93734

SEQ ID NO: 121664 - RNA, 1401 nt, Artificial Sequence
  derived and/or modified sequence opt2 from neuraminidase__InfluenzaB__AHL93745
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacguccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121665 - RNA, 1401 nt, Artificial Sequence; identical to SEQ ID NO: 120631
  derived and/or modified sequence opt2 from neuraminidase__InfluenzaB__AHL93756

SEQ ID NO: 121666 - RNA, 1401 nt, Artificial Sequence; identical to SEQ ID NO: 121652
  derived and/or modified sequence opt2 from neuraminidase__InfluenzaB__AHL93767

SEQ ID NO: 121667 - RNA, 1401 nt, Artificial Sequence
  derived and/or modified sequence opt2 from neuraminidase__InfluenzaB__AHL93778
augcuccccuccaccauccagacccucauccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaucuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121668 - RNA, 1401 nt, Artificial Sequence
  derived and/or modified sequence opt2 from neuraminidase__InfluenzaB__AHL93789
augcuccccuccaccauccagacccucacccucuuccucaccuccggcggcguccuccucucccucuacgucuccgccucccucuccuaccuccucuacuccgacauccuccucaaguucucccccaccggcaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121669 - RNA, 1401 nt, Artificial Sequence; identical to SEQ ID NO: 120468
  derived and/or modified sequence opt2 from neuraminidase__InfluenzaB__AHL93800

SEQ ID NO: 121670 - RNA, 1401 nt, Artificial Sequence; identical to SEQ ID NO: 120468
  derived and/or modified sequence opt2 from neuraminidase__InfluenzaB__AHL93811

SEQ ID NO: 121671 - RNA, 1401 nt, Artificial Sequence; identical to SEQ ID NO: 121004
  derived and/or modified sequence opt2 from neuraminidase__InfluenzaB__AHL93822

SEQ ID NO: 121672 - RNA, 1401 nt, Artificial Sequence; identical to SEQ ID NO: 120468
  derived and/or modified sequence opt2 from neuraminidase__InfluenzaB__AHL93833

SEQ ID NO: 121673 - RNA, 1401 nt, Artificial Sequence
  derived and/or modified sequence opt2 from neuraminidase__InfluenzaB__AHL93844
augcuccccuccaccauccagacccucacccucuuccucaccuccggcggcguccuccucucccucuacgucuccgccucccucuccuaccuccucuacuccggcauccuccucaaguucucccccaccgagaucaccgcccccaccaugccccucgacugcgccaacgccuccaacguccaggccgucaaccgcuccgccaccaaggaggucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacgacaacgcccuccucaaggucaaguacggcgaggccuacaccgacaccuaccacuccuacgcccacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121674 - RNA, 1401 nt, Artificial Sequence; identical to SEQ ID NO: 120468
  derived and/or modified sequence opt2 from neuraminidase__InfluenzaB__AHL93855

SEQ ID NO: 121675 - RNA, 1401 nt, Artificial Sequence; identical to SEQ ID NO: 120468
  derived and/or modified sequence opt2 from neuraminidase__InfluenzaB__AHL93866

SEQ ID NO: 121676 - RNA, 1401 nt, Artificial Sequence; identical to SEQ ID NO: 120468
  derived and/or modified sequence opt2 from neuraminidase__InfluenzaB__AHL93877

SEQ ID NO: 121677 - RNA, 1401 nt, Artificial Sequence; identical to SEQ ID NO: 120468
  derived and/or modified sequence opt2 from neuraminidase__InfluenzaB__AHL93888

SEQ ID NO: 121678 - RNA, 1401 nt, Artificial Sequence
  derived and/or modified sequence opt2 from neuraminidase__InfluenzaB__AHL93899
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcgagcccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaccaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121679 - RNA, 1401 nt, Artificial Sequence
  derived and/or modified sequence opt2 from neuraminidase__InfluenzaB__AHL93910
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcaccugccgcgacaacuccuacaccgccaagcgccccuucgucaagcucaacgucgagaccgacaccgccgagauccgccucaugugcaccgacaccuaccucgacaccccccgccccgacgacggcggcaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121680 - RNA, 1401 nt, Artificial Sequence; identical to SEQ ID NO: 120468
  derived and/or modified sequence opt2 from neuraminidase__InfluenzaB__AHL93921

SEQ ID NO: 121681 - RNA, 1401 nt, Artificial Sequence
  derived and/or modified sequence opt2 from neuraminidase__InfluenzaB__AHL93932
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcauggagcucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121682 - RNA, 1401 nt, Artificial Sequence; identical to SEQ ID NO: 120631
  derived and/or modified sequence opt2 from neuraminidase__InfluenzaB__AHL93943

SEQ ID NO: 121683 - RNA, 1401 nt, Artificial Sequence; identical to SEQ ID NO: 120468
  derived and/or modified sequence opt2 from neuraminidase__InfluenzaB__AHL93954

SEQ ID NO: 121684 - RNA, 1401 nt, Artificial Sequence
  derived and/or modified sequence opt2 from neuraminidase__InfluenzaB__AHL93965
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaacugcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcaacggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121685 - RNA, 1401 nt, Artificial Sequence; identical to SEQ ID NO: 120387
  derived and/or modified sequence opt2 from neuraminidase__InfluenzaB__AHL93976

SEQ ID NO: 121686 - RNA, 1401 nt, Artificial Sequence; identical to SEQ ID NO: 121658
  derived and/or modified sequence opt2 from neuraminidase__InfluenzaB__AHL93987

SEQ ID NO: 121687 - RNA, 1401 nt, Artificial Sequence
  derived and/or modified sequence opt2 from neuraminidase__InfluenzaB__AHL93998
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121688 - RNA, 1401 nt, Artificial Sequence
  derived and/or modified sequence opt2 from neuraminidase__InfluenzaB__AHL94009
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccaaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugccgccacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121689 - RNA, 1401 nt, Artificial Sequence; identical to SEQ ID NO: 120468
  derived and/or modified sequence opt2 from neuraminidase__InfluenzaB__AHL94020

SEQ ID NO: 121690 - RNA, 1401 nt, Artificial Sequence; identical to SEQ ID NO: 120468
  derived and/or modified sequence opt2 from neuraminidase__InfluenzaB__AHL94031

SEQ ID NO: 121691 - RNA, 1401 nt, Artificial Sequence; identical to SEQ ID NO: 120631
  derived and/or modified sequence opt2 from neuraminidase__InfluenzaB__AHL94042

SEQ ID NO: 121692 - RNA, 1401 nt, Artificial Sequence
  derived and/or modified sequence opt2 from neuraminidase__InfluenzaB__AHL94053
augcuccccuccaccauccagacccucacccucuuccucaccuccggcggcguccuccucucccucuaccucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121693 - RNA, 1401 nt, Artificial Sequence; identical to SEQ ID NO: 120468
  derived and/or modified sequence opt2 from neuraminidase__InfluenzaB__AHL94064

SEQ ID NO: 121694 - RNA, 1401 nt, Artificial Sequence; identical to SEQ ID NO: 120468
  derived and/or modified sequence opt2 from neuraminidase__InfluenzaB__AHL94075

SEQ ID NO: 121695 - RNA, 1401 nt, Artificial Sequence
  derived and/or modified sequence opt2 from neuraminidase__InfluenzaB__AHL94086
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucgucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121696 - RNA, 1401 nt, Artificial Sequence; identical to SEQ ID NO: 120631
  derived and/or modified sequence opt2 from neuraminidase__InfluenzaB__AHL94095

SEQ ID NO: 121697 - RNA, 1401 nt, Artificial Sequence; identical to SEQ ID NO: 120468
  derived and/or modified sequence opt2 from neuraminidase__InfluenzaB__AHL94106

SEQ ID NO: 121698 - RNA, 1401 nt, Artificial Sequence
  derived and/or modified sequence opt2 from neuraminidase__InfluenzaB__AHL94117
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccuccacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121699 - RNA, 1401 nt, Artificial Sequence; identical to SEQ ID NO: 120468
  derived and/or modified sequence opt2 from neuraminidase__InfluenzaB__AHL94128

SEQ ID NO: 121700 - RNA, 1401 nt, Artificial Sequence
  derived and/or modified sequence opt2 from neuraminidase__InfluenzaB__AHL94139
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccccgagcccgaguggaccuacccccgccucuccugccccggcuccaccuuccagcgcgcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagaucaagcucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121701 - RNA, 1401 nt, Artificial Sequence; identical to SEQ ID NO: 121658
  derived and/or modified sequence opt2 from neuraminidase__InfluenzaB__AHL94150

SEQ ID NO: 121702 - RNA, 1401 nt, Artificial Sequence
  derived and/or modified sequence opt2 from neuraminidase__InfluenzaB__AHL94161
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccaagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121703 - RNA, 1401 nt, Artificial Sequence; identical to SEQ ID NO: 121658
  derived and/or modified sequence opt2 from neuraminidase__InfluenzaB__AHL94183

SEQ ID NO: 121704 - RNA, 1404 nt, Artificial Sequence
  derived and/or modified sequence opt2 from neuraminidase__InfluenzaB__AHL94194
augcuccccuccaccauccagacccucacccucuuccucaccuccggcggcguccuccucucccucuacgucuccgcccuccucuccuaccuccucuacuccgacauccuccucaaguucucccccaccgagaucaccgcccccaccaugucccucgacugcgccaacgccuccaacguccaggccgucaaccgcuccgccaccaagggcgucaccuuccuccuccuccccgagcccgaguggaccuacccccgccucuccugccccggcuccaccuuccagcgcgcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacgacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121705 - RNA, 1401 nt, Artificial Sequence; identical to SEQ ID NO: 120468
  derived and/or modified sequence opt2 from neuraminidase__InfluenzaB__AHL94205

SEQ ID NO: 121706 - RNA, 1401 nt, Artificial Sequence; identical to SEQ ID NO: 120631
  derived and/or modified sequence opt2 from neuraminidase__InfluenzaB__AHL94214

SEQ ID NO: 121707 - RNA, 1401 nt, Artificial Sequence
  derived and/or modified sequence opt2 from neuraminidase__InfluenzaB__AHL94224
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaucgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121708 - RNA, 1401 nt, Artificial Sequence; identical to SEQ ID NO: 120468
  derived and/or modified sequence opt2 from neuraminidase__InfluenzaB__AHL94235

SEQ ID NO: 121709 - RNA, 1401 nt, Artificial Sequence; identical to SEQ ID NO: 120631
  derived and/or modified sequence opt2 from neuraminidase__InfluenzaB__AHL94246

SEQ ID NO: 121710 - RNA, 1401 nt, Artificial Sequence; identical to SEQ ID NO: 120631
  derived and/or modified sequence opt2 from neuraminidase__InfluenzaB__AHL94257

SEQ ID NO: 121711 - RNA, 1401 nt, Artificial Sequence; identical to SEQ ID NO: 120329
  derived and/or modified sequence opt2 from neuraminidase__InfluenzaB__AHL94267

SEQ ID NO: 121712 - RNA, 1401 nt, Artificial Sequence; identical to SEQ ID NO: 120329
  derived and/or modified sequence opt2 from neuraminidase__InfluenzaB__AHL94278

SEQ ID NO: 121713 - RNA, 1401 nt, Artificial Sequence; identical to SEQ ID NO: 120329
  derived and/or modified sequence opt2 from neuraminidase__InfluenzaB__AHL94299

SEQ ID NO: 121714 - RNA, 1401 nt, Artificial Sequence
  derived and/or modified sequence opt2 from neuraminidase__InfluenzaB__AHL94310
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucgccggccccugcgaguccaacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121715 - RNA, 1401 nt, Artificial Sequence; identical to SEQ ID NO: 121714
  derived and/or modified sequence opt2 from neuraminidase__InfluenzaB__AHL94321

SEQ ID NO: 121716 - RNA, 1401 nt, Artificial Sequence
  derived and/or modified sequence opt2 from neuraminidase__InfluenzaB__AHL94332
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121717 - RNA, 1401 nt, Artificial Sequence; identical to SEQ ID NO: 120329
  derived and/or modified sequence opt2 from neuraminidase__InfluenzaB__AHL94343

SEQ ID NO: 121718 - RNA, 1401 nt, Artificial Sequence
  derived and/or modified sequence opt2 from neuraminidase__InfluenzaB__AHL94354
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121719 - RNA, 1401 nt, Artificial Sequence; identical to SEQ ID NO: 121718
  derived and/or modified sequence opt2 from neuraminidase__InfluenzaB__AHL94365

SEQ ID NO: 121720 - RNA, 1401 nt, Artificial Sequence
  derived and/or modified sequence opt2 from neuraminidase__InfluenzaB__AHL94387
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaccguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuaccucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaucuggcacuccgccgccaccgccaucuacugccucaugggcuccggccagcuccucugggacaccgucaccggcgucgacauggcccucuga

SEQ ID NO: 121721 - RNA, 1404 nt, Artificial Sequence
  derived and/or modified sequence opt2 from neuraminidase__InfluenzaB__AHL94398
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121722 - RNA, 1401 nt, Artificial Sequence; identical to SEQ ID NO: 121718
  derived and/or modified sequence opt2 from neuraminidase__InfluenzaB__AHL94409

SEQ ID NO: 121723 - RNA, 1401 nt, Artificial Sequence
  derived and/or modified sequence opt2 from neuraminidase__InfluenzaB__AHL94431
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccgccaagggcgucacccucauccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugaucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121724 - RNA, 1401 nt, Artificial Sequence
  derived and/or modified sequence opt2 from neuraminidase__InfluenzaB__AHL94442
augcuccccuccaccauccagacccucacccucuuccucaccuccggcggcguccuccucucccucuacauguccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucgccggccccugcgaguccaacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121725 - RNA, 1401 nt, Artificial Sequence; identical to SEQ ID NO: 121714
  derived and/or modified sequence opt2 from neuraminidase__InfluenzaB__AHL94464

SEQ ID NO: 121726 - RNA, 1401 nt, Artificial Sequence; identical to SEQ ID NO: 120329
  derived and/or modified sequence opt2 from neuraminidase__InfluenzaB__AHL94475

SEQ ID NO: 121727 - RNA, 1401 nt, Artificial Sequence; identical to SEQ ID NO: 121718
  derived and/or modified sequence opt2 from neuraminidase__InfluenzaB__AHL94486

SEQ ID NO: 121728 - RNA, 1401 nt, Artificial Sequence; identical to SEQ ID NO: 120329
  derived and/or modified sequence opt2 from neuraminidase__InfluenzaB__AHL94497

SEQ ID NO: 121729 - RNA, 1401 nt, Artificial Sequence; identical to SEQ ID NO: 121714
  derived and/or modified sequence opt2 from neuraminidase__InfluenzaB__AHL94508

SEQ ID NO: 121730 - RNA, 1401 nt, Artificial Sequence
  derived and/or modified sequence opt2 from neuraminidase__InfluenzaB__AHL94519
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccuggaccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121731 - RNA, 1401 nt, Artificial Sequence; identical to SEQ ID NO: 121714
  derived and/or modified sequence opt2 from neuraminidase__InfluenzaB__AHL94530

SEQ ID NO: 121732 - RNA, 1401 nt, Artificial Sequence; identical to SEQ ID NO: 121718
  derived and/or modified sequence opt2 from neuraminidase__InfluenzaB__AHL94541

SEQ ID NO: 121733 - RNA, 1401 nt, Artificial Sequence
  derived and/or modified sequence opt2 from neuraminidase__InfluenzaB__AHL94563
augcuccccuccaccauccagacccucacccucuuccucacccucggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121734 - RNA, 1401 nt, Artificial Sequence; identical to SEQ ID NO: 121687
  derived and/or modified sequence opt2 from neuraminidase__InfluenzaB__AHL94574

SEQ ID NO: 121735 - RNA, 1401 nt, Artificial Sequence
  derived and/or modified sequence opt2 from neuraminidase__InfluenzaB__AHL94585
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaagggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121736 - RNA, 1401 nt, Artificial Sequence; identical to SEQ ID NO: 121687
  derived and/or modified sequence opt2 from neuraminidase__InfluenzaB__AHL94596

SEQ ID NO: 121737 - RNA, 1401 nt, Artificial Sequence
  derived and/or modified sequence opt2 from neuraminidase__InfluenzaB__AHL94607
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgccucaaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121738 - RNA, 1401 nt, Artificial Sequence; identical to SEQ ID NO: 121718
  derived and/or modified sequence opt2 from neuraminidase__InfluenzaB__AHL94618

SEQ ID NO: 121739 - RNA, 1401 nt, Artificial Sequence; identical to SEQ ID NO: 121714
  derived and/or modified sequence opt2 from neuraminidase__InfluenzaB__AHL94628

SEQ ID NO: 121740 - RNA, 1401 nt, Artificial Sequence; identical to SEQ ID NO: 121718
  derived and/or modified sequence opt2 from neuraminidase__InfluenzaB__AHL94639

SEQ ID NO: 121741 - RNA, 1401 nt, Artificial Sequence
  derived and/or modified sequence opt2 from neuraminidase__InfluenzaB__AHL94650
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucauccgcgagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121742 - RNA, 1401 nt, Artificial Sequence
  derived and/or modified sequence opt2 from neuraminidase__InfluenzaB__AHL94661
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcauccagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgaggacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacaacggcgaccccugggccgacuccgacgcccucgucuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 121743 - RNA, 1401 nt, Artificial Sequence
  derived and/or modified sequence opt2 from neuraminidase__InfluenzaB__AHL94672
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucuccggccccugcgaguccaacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121744 - RNA, 1401 nt, Artificial Sequence
  derived and/or modified sequence opt2 from neuraminidase__InfluenzaB__AHL94683
augcuccccuccaccauccagacccucacccucuuccucaccuccggcggcguccuccucucccucuacgucuccgccucccucuccuaccuccucuacuccgacauccuccucaaguucucccgcaccgagaucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcggcgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121745 - RNA, 1401 nt, Artificial Sequence
  derived and/or modified sequence opt2 from neuraminidase__InfluenzaB__AHL94694
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121746 - RNA, 1401 nt, Artificial Sequence; identical to SEQ ID NO: 121718
  derived and/or modified sequence opt2 from neuraminidase__InfluenzaB__AHL94705

SEQ ID NO: 121747 - RNA, 1401 nt, Artificial Sequence; identical to SEQ ID NO: 120329
  derived and/or modified sequence opt2 from neuraminidase__InfluenzaB__AHL94716

SEQ ID NO: 121748 - RNA, 1401 nt, Artificial Sequence
  derived and/or modified sequence opt2 from neuraminidase__InfluenzaB__AHL94727
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacaccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcauccagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgaggacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacaacggcgaccccugggccgacuccgacgcccucgucuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 121749 - RNA, 1401 nt, Artificial Sequence; identical to SEQ ID NO: 120329
  derived and/or modified sequence opt2 from neuraminidase__InfluenzaB__AHL94738

SEQ ID NO: 121750 - RNA, 1401 nt, Artificial Sequence
  derived and/or modified sequence opt2 from neuraminidase__InfluenzaB__AHL94749
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcgucgagaugguccacgacggcggcaaggagaccuggcacuccgccgccaccgccaucuacugccucaugggcuccggccagcuccucugggacaccgucaccggcgucgacauggcccucuga

SEQ ID NO: 121751 - RNA, 1401 nt, Artificial Sequence
  derived and/or modified sequence opt2 from neuraminidase__InfluenzaB__AHL94760
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacauccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121752 - RNA, 1401 nt, Artificial Sequence; identical to SEQ ID NO: 121718
  derived and/or modified sequence opt2 from neuraminidase__InfluenzaB__AHL94770

SEQ ID NO: 121753 - RNA, 1401 nt, Artificial Sequence; identical to SEQ ID NO: 121716
  derived and/or modified sequence opt2 from neuraminidase__InfluenzaB__AHL94781

SEQ ID NO: 121754 - RNA, 1401 nt, Artificial Sequence; identical to SEQ ID NO: 121714
  derived and/or modified sequence opt2 from neuraminidase__InfluenzaB__AHL94791

SEQ ID NO: 121755 - RNA, 1401 nt, Artificial Sequence; identical to SEQ ID NO: 121745
  derived and/or modified sequence opt2 from neuraminidase__InfluenzaB__AHL94801

SEQ ID NO: 121756 - RNA, 1401 nt, Artificial Sequence; identical to SEQ ID NO: 121714
  derived and/or modified sequence opt2 from neuraminidase__InfluenzaB__AHL94812

SEQ ID NO: 121757 - RNA, 1401 nt, Artificial Sequence; identical to SEQ ID NO: 121714
  derived and/or modified sequence opt2 from neuraminidase__InfluenzaB__AHL94821

SEQ ID NO: 121758 - RNA, 1401 nt, Artificial Sequence; identical to SEQ ID NO: 121718
  derived and/or modified sequence opt2 from neuraminidase__InfluenzaB__AHL94831

SEQ ID NO: 121759 - RNA, 1401 nt, Artificial Sequence
  derived and/or modified sequence opt2 from neuraminidase__InfluenzaB__AHL94840
augcuccccuccaccauccagacccucacccucuuccucaccuccggcggcguccuccucucccucuacgucuccgccucccucuccuaccuccucuacuccggcauccuccucaaguucucccgcaccgagaucaccgcccccaucaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121760 - RNA, 1401 nt, Artificial Sequence
  derived and/or modified sequence opt2 from neuraminidase__InfluenzaB__AHL94851
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcaugaccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121761 - RNA, 1401 nt, Artificial Sequence; identical to SEQ ID NO: 120147
  derived and/or modified sequence opt2 from neuraminidase__InfluenzaB__AHL94862

SEQ ID NO: 121762 - RNA, 1401 nt, Artificial Sequence; identical to SEQ ID NO: 120329
  derived and/or modified sequence opt2 from neuraminidase__InfluenzaB__AHL94873

SEQ ID NO: 121763 - RNA, 1401 nt, Artificial Sequence; identical to SEQ ID NO: 121633
  derived and/or modified sequence opt2 from neuraminidase__InfluenzaB__AHL94884

SEQ ID NO: 121764 - RNA, 1401 nt, Artificial Sequence; identical to SEQ ID NO: 120473
  derived and/or modified sequence opt2 from neuraminidase__InfluenzaB__AHL94893

SEQ ID NO: 121765 - RNA, 1401 nt, Artificial Sequence; identical to SEQ ID NO: 120473
  derived and/or modified sequence opt2 from neuraminidase__InfluenzaB__AHL94904

SEQ ID NO: 121766 - RNA, 1401 nt, Artificial Sequence
  derived and/or modified sequence opt2 from neuraminidase__InfluenzaB__AHL94915
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggucgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121767 - RNA, 1401 nt, Artificial Sequence; identical to SEQ ID NO: 121633
  derived and/or modified sequence opt2 from neuraminidase__InfluenzaB__AHL94926

SEQ ID NO: 121768 - RNA, 1401 nt, Artificial Sequence
  derived and/or modified sequence opt2 from neuraminidase__InfluenzaB__AHL94937
augcuccccuccaccauccagacccucacccucuuccucaccuccggcggcguccuccucucccucuacgucuccgccucccucuccuaccuccucuacuccgacauccuccucaaguucucccccaccgagaucaccgcccccacccucccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121769 - RNA, 1401 nt, Artificial Sequence; identical to SEQ ID NO: 121652
  derived and/or modified sequence opt2 from neuraminidase__InfluenzaB__AHL94948

SEQ ID NO: 121770 - RNA, 1401 nt, Artificial Sequence; identical to SEQ ID NO: 120468
  derived and/or modified sequence opt2 from neuraminidase__InfluenzaB__AHL94959

SEQ ID NO: 121771 - RNA, 1401 nt, Artificial Sequence; identical to SEQ ID NO: 120468
  derived and/or modified sequence opt2 from neuraminidase__InfluenzaB__AHL94969

SEQ ID NO: 121772 - RNA, 1401 nt, Artificial Sequence; identical to SEQ ID NO: 120468
  derived and/or modified sequence opt2 from neuraminidase__InfluenzaB__AHL94978

SEQ ID NO: 121773 - RNA, 1401 nt, Artificial Sequence
  derived and/or modified sequence opt2 from neuraminidase__InfluenzaB__AHM00990
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121774 - RNA, 1401 nt, Artificial Sequence; identical to SEQ ID NO: 121718
  derived and/or modified sequence opt2 from neuraminidase__InfluenzaB__AHM01001

SEQ ID NO: 121775 - RNA, 1401 nt, Artificial Sequence
  derived and/or modified sequence opt2 from neuraminidase__InfluenzaB__AHM01012
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccuggaccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121776 - RNA, 1401 nt, Artificial Sequence; identical to SEQ ID NO: 121718
  derived and/or modified sequence opt2 from neuraminidase__InfluenzaB__AHM01023

SEQ ID NO: 121777 - RNA, 1401 nt, Artificial Sequence; identical to SEQ ID NO: 121718
  derived and/or modified sequence opt2 from neuraminidase__InfluenzaB__AHM01034

SEQ ID NO: 121778 - RNA, 1401 nt, Artificial Sequence
  derived and/or modified sequence opt2 from neuraminidase__InfluenzaB__AHM01045
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccggcuggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucgccggcgucgacauggcccucuga

SEQ ID NO: 121779 - RNA, 1401 nt, Artificial Sequence
  derived and/or modified sequence opt2 from neuraminidase__InfluenzaB__AHM01056
augcuccccuccaccacccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121780 - RNA, 1401 nt, Artificial Sequence; identical to SEQ ID NO: 121718
  derived and/or modified sequence opt2 from neuraminidase__InfluenzaB__AHM01067

SEQ ID NO: 121781 - RNA, 1401 nt, Artificial Sequence; identical to SEQ ID NO: 121687
  derived and/or modified sequence opt2 from neuraminidase__InfluenzaB__AHM01078

SEQ ID NO: 121782 - RNA, 1401 nt, Artificial Sequence
  derived and/or modified sequence opt2 from neuraminidase__InfluenzaB__AHM01089
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121783 - RNA, 1401 nt, Artificial Sequence; identical to SEQ ID NO: 121687
  derived and/or modified sequence opt2 from neuraminidase__InfluenzaB__AHM01100

SEQ ID NO: 121784 - RNA, 1401 nt, Artificial Sequence; identical to SEQ ID NO: 121718
  derived and/or modified sequence opt2 from neuraminidase__InfluenzaB__AHM01111

SEQ ID NO: 121785 - RNA, 1401 nt, Artificial Sequence
  derived and/or modified sequence opt2 from neuraminidase__InfluenzaB__AHM01122
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaagcuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121786 - RNA, 1401 nt, Artificial Sequence; identical to SEQ ID NO: 121718
  derived and/or modified sequence opt2 from neuraminidase__InfluenzaB__AHM01133

SEQ ID NO: 121787 - RNA, 1401 nt, Artificial Sequence
  derived and/or modified sequence opt2 from neuraminidase__InfluenzaB__AHM01144
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121788 - RNA, 1401 nt, Artificial Sequence; identical to SEQ ID NO: 121718
  derived and/or modified sequence opt2 from neuraminidase__InfluenzaB__AHM01166

SEQ ID NO: 121789 - RNA, 1401 nt, Artificial Sequence
  derived and/or modified sequence opt2 from neuraminidase__InfluenzaB__AHM01188
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121790 - RNA, 1401 nt, Artificial Sequence; identical to SEQ ID NO: 121782
  derived and/or modified sequence opt2 from neuraminidase__InfluenzaB__AHM01199

SEQ ID NO: 121791 - RNA, 1401 nt, Artificial Sequence
  derived and/or modified sequence opt2 from neuraminidase__InfluenzaB__AHM01210
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccggcuggaccuacccccgccucuccugccccggcuccaccuuccagaaggcccuccucaucuccccccaccgcuucggcgaggccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucgccggcgucgacauggcccucuga

SEQ ID NO: 121792 - RNA, 1401 nt, Artificial Sequence
  derived and/or modified sequence opt2 from neuraminidase__InfluenzaB__AHM01221
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacuuccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121793 - RNA, 1401 nt, Artificial Sequence; identical to SEQ ID NO: 121687
  derived and/or modified sequence opt2 from neuraminidase__InfluenzaB__AHM01232

SEQ ID NO: 121794 - RNA, 1401 nt, Artificial Sequence; identical to SEQ ID NO: 121718
  derived and/or modified sequence opt2 from neuraminidase__InfluenzaB__AHM01243

SEQ ID NO: 121795 - RNA, 1401 nt, Artificial Sequence
  derived and/or modified sequence opt2 from neuraminidase__InfluenzaB__AHM01254
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121796 - RNA, 1401 nt, Artificial Sequence
  derived and/or modified sequence opt2 from neuraminidase__InfluenzaB__AHM01265
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccgccuccucugggacaccgucaccggcgucgacauggcccucuga

SEQ ID NO: 121797 - RNA, 1401 nt, Artificial Sequence
  derived and/or modified sequence opt2 from neuraminidase__InfluenzaB__AHM01276
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121798 - RNA, 1401 nt, Artificial Sequence; identical to SEQ ID NO: 121782
  derived and/or modified sequence opt2 from neuraminidase__InfluenzaB__AHM01287

SEQ ID NO: 121799 - RNA, 1401 nt, Artificial Sequence; identical to SEQ ID NO: 121782
  derived and/or modified sequence opt2 from neuraminidase__InfluenzaB__AHM01298

SEQ ID NO: 121800 - RNA, 1401 nt, Artificial Sequence; identical to SEQ ID NO: 121797
  derived and/or modified sequence opt2 from neuraminidase__InfluenzaB__AHM01309

SEQ ID NO: 121801 - RNA, 1401 nt, Artificial Sequence; identical to SEQ ID NO: 121718
  derived and/or modified sequence opt2 from neuraminidase__InfluenzaB__AHM01320

SEQ ID NO: 121802 - RNA, 1401 nt, Artificial Sequence; identical to SEQ ID NO: 121782
  derived and/or modified sequence opt2 from neuraminidase__InfluenzaB__AHM01331

SEQ ID NO: 121803 - RNA, 1401 nt, Artificial Sequence; identical to SEQ ID NO: 121718
  derived and/or modified sequence opt2 from neuraminidase__InfluenzaB__AHM01342

SEQ ID NO: 121804 - RNA, 1401 nt, Artificial Sequence
  derived and/or modified sequence opt2 from neuraminidase__InfluenzaB__AHM01353
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccggcuggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121805 - RNA, 1401 nt, Artificial Sequence
  derived and/or modified sequence opt2 from neuraminidase__InfluenzaB__AHM01364
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121806 - RNA, 1401 nt, Artificial Sequence; identical to SEQ ID NO: 121797
  derived and/or modified sequence opt2 from neuraminidase__InfluenzaB__AHM01375

SEQ ID NO: 121807 - RNA, 1401 nt, Artificial Sequence; identical to SEQ ID NO: 121797
  derived and/or modified sequence opt2 from neuraminidase__InfluenzaB__AHM01386

SEQ ID NO: 121808 - RNA, 1401 nt, Artificial Sequence; identical to SEQ ID NO: 121718
  derived and/or modified sequence opt2 from neuraminidase__InfluenzaB__AHM01397

SEQ ID NO: 121809 - RNA, 1401 nt, Artificial Sequence; identical to SEQ ID NO: 121718
  derived and/or modified sequence opt2 from neuraminidase__InfluenzaB__AHM01408

SEQ ID NO: 121810 - RNA, 1401 nt, Artificial Sequence; identical to SEQ ID NO: 121718
  derived and/or modified sequence opt2 from neuraminidase__InfluenzaB__AHM01419

SEQ ID NO: 121811 - RNA, 1401 nt, Artificial Sequence
  derived and/or modified sequence opt2 from neuraminidase__InfluenzaB__AHM01430
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccgccuccucugggacaccgccaccggcgucgacauggcccucuga

SEQ ID NO: 121812 - RNA, 1401 nt, Artificial Sequence
  derived and/or modified sequence opt2 from neuraminidase__InfluenzaB__AHM01441
augcuccccuccaccauccagacccucacccucuuccucaccuccggcggcguccuccucucccucuacgucuccgccucccucuccuaccuccucuacuccgacauccuccucaaguucucccagaccgagaucaccgcccccaccaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121813 - RNA, 1401 nt, Artificial Sequence; identical to SEQ ID NO: 121718
  derived and/or modified sequence opt2 from neuraminidase__InfluenzaB__AHM01463

SEQ ID NO: 121814 - RNA, 1401 nt, Artificial Sequence
  derived and/or modified sequence opt2 from neuraminidase__InfluenzaB__AHM01474
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaucaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121815 - RNA, 1401 nt, Artificial Sequence
  derived and/or modified sequence opt2 from neuraminidase__InfluenzaB__AHM01485
augcuccccuccaccauccagacccucacccucuuccucaccuccggcggcguccuccucucccucuacgucuccgccucccucuccuaccuccucuacuccgacauccuccucaaguucucccccaccgagaucaccgcccccaucaugccccucgacugcaccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121816 - RNA, 1401 nt, Artificial Sequence; identical to SEQ ID NO: 121797
  derived and/or modified sequence opt2 from neuraminidase__InfluenzaB__AHM01496

SEQ ID NO: 121817 - RNA, 1401 nt, Artificial Sequence
  derived and/or modified sequence opt2 from neuraminidase__InfluenzaB__AHM01507
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucguccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121818 - RNA, 1401 nt, Artificial Sequence; identical to SEQ ID NO: 121797
  derived and/or modified sequence opt2 from neuraminidase__InfluenzaB__AHM01518

SEQ ID NO: 121819 - RNA, 1401 nt, Artificial Sequence
  derived and/or modified sequence opt2 from neuraminidase__InfluenzaB__AHM01529
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagauccuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121820 - RNA, 1401 nt, Artificial Sequence; identical to SEQ ID NO: 121687
  derived and/or modified sequence opt2 from neuraminidase__InfluenzaB__AHM01540

SEQ ID NO: 121821 - RNA, 1401 nt, Artificial Sequence; identical to SEQ ID NO: 121797
  derived and/or modified sequence opt2 from neuraminidase__InfluenzaB__AHM01551

SEQ ID NO: 121822 - RNA, 1401 nt, Artificial Sequence; identical to SEQ ID NO: 121797
  derived and/or modified sequence opt2 from neuraminidase__InfluenzaB__AHM01562

SEQ ID NO: 121823 - RNA, 1401 nt, Artificial Sequence; identical to SEQ ID NO: 120304
  derived and/or modified sequence opt2 from neuraminidase__InfluenzaB__AHZ13597

SEQ ID NO: 121824 - RNA, 1404 nt, Artificial Sequence
  derived and/or modified sequence opt2 from neuraminidase__InfluenzaB__AHZ36701
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcaagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121825 - RNA, 1404 nt, Artificial Sequence
  derived and/or modified sequence opt2 from neuraminidase__InfluenzaB__AHZ36756
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaugggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121826 - RNA, 1401 nt, Artificial Sequence
  derived and/or modified sequence opt2 from neuraminidase__InfluenzaB__AHZ36767
augcuccccuccaccauccagacccucacccucuuccucaccuccggcggcguccuccucucccucuacgucuccgccucccucuccuaccuccucuacuccgacauccuccucaaguucucccccaccgagaucaccgcccccacccgcccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121827 - RNA, 1401 nt, Artificial Sequence
  derived and/or modified sequence opt2 from neuraminidase__InfluenzaB__AHZ36778
augcuccccuccaccauccagacccucacccucuuccucaccuccggcggcguccuccucucccucuacgucuccgccucccucuccuaccuccucuacuccgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcauccagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgaggacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacaacggcgaccccugggccgacuccgacgcccucgucuucuccggcgucaugaucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 121828 - RNA, 1401 nt, Artificial Sequence
  derived and/or modified sequence opt2 from neuraminidase__InfluenzaB__AHZ36789
augcuccccuccaccauccagacccucacccucuuccucaccuccggcggcguccuccucucccucuacgucuccgccucccucuccuaccuccucuacuccgacauccuccucaaguucucccccaccgagaucaccgcccagaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaugaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121829 - RNA, 1401 nt, Artificial Sequence; identical to SEQ ID NO: 121828
  derived and/or modified sequence opt2 from neuraminidase__InfluenzaB__AHZ36800

SEQ ID NO: 121830 - RNA, 1401 nt, Artificial Sequence
  derived and/or modified sequence opt2 from neuraminidase__InfluenzaB__AHZ36811
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcaccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucauccgcgagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121831 - RNA, 1404 nt, Artificial Sequence; identical to SEQ ID NO: 121825
  derived and/or modified sequence opt2 from neuraminidase__InfluenzaB__AHZ36822

SEQ ID NO: 121832 - RNA, 1401 nt, Artificial Sequence
  derived and/or modified sequence opt2 from neuraminidase__InfluenzaB__AHZ36833
augcuccccuccaccauccagacccucacccucuuccucaccuccggcggcguccuccucucccucuacgucuccgccucccucuccuaccuccucuacuccgacauccuccucaaguucucccccaccgagaucaccgcccccacccgcccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagguccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121833 - RNA, 1401 nt, Artificial Sequence
  derived and/or modified sequence opt2 from neuraminidase__InfluenzaB__AHZ36844
augcuccccuccaccauccagacccucacccucuuccucaccuccggcggcguccuccucucccucuacgucuccgccucccucuccuaccuccucuacuccgacauccuccucaaguucucccccaccgagaucaccgcccccacccgcccccucgacugcgccaacgccuccaacguccaggccgucaaccgcuccgccaccaaggaggucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121834 - RNA, 1401 nt, Artificial Sequence
  derived and/or modified sequence opt2 from neuraminidase__InfluenzaB__AHZ36855
augcuccccuccaccauccagacccucacccucuuccucaccuccggcggcguccuccucucccucuacgucuccgccucccucuccuaccuccucuacuccgacauccuccucaaguucucccccaccgagaucaccguccagaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaugaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121835 - RNA, 1404 nt, Artificial Sequence; identical to SEQ ID NO: 121825
  derived and/or modified sequence opt2 from neuraminidase__InfluenzaB__AHZ36866

SEQ ID NO: 121836 - RNA, 1401 nt, Artificial Sequence
  derived and/or modified sequence opt2 from neuraminidase__InfluenzaB__AHZ36877
augcuccccuccaccauccagacccucacccucuuccucaccuccggcggcguccuccucucccucuacgucuccgccucccucuccuaccuccucuacuccgacauccuccucaaguucuccccccccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121837 - RNA, 1404 nt, Artificial Sequence; identical to SEQ ID NO: 121825
  derived and/or modified sequence opt2 from neuraminidase__InfluenzaB__AHZ36888

SEQ ID NO: 121838 - RNA, 1404 nt, Artificial Sequence; identical to SEQ ID NO: 121825
  derived and/or modified sequence opt2 from neuraminidase__InfluenzaB__AHZ36899

SEQ ID NO: 121839 - RNA, 1404 nt, Artificial Sequence; identical to SEQ ID NO: 121825
  derived and/or modified sequence opt2 from neuraminidase__InfluenzaB__AHZ36910

SEQ ID NO: 121840 - RNA, 1401 nt, Artificial Sequence; identical to SEQ ID NO: 121827
  derived and/or modified sequence opt2 from neuraminidase__InfluenzaB__AHZ36921

SEQ ID NO: 121841 - RNA, 1401 nt, Artificial Sequence
  derived and/or modified sequence opt2 from neuraminidase__InfluenzaB__AHZ36932
augcuccccuccaccauccagacccucacccucuuccucaccuccggcggcguccuccucucccucuacgucuccgccucccucuccuaccuccucuacuccgacauccuccucaaguucucccccaccgagaucaccgcccagaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccauggagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaugaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121842 - RNA, 1401 nt, Artificial Sequence
  derived and/or modified sequence opt2 from neuraminidase__InfluenzaB__AHZ36943
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaugaaggaccgcaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121843 - RNA, 1404 nt, Artificial Sequence; identical to SEQ ID NO: 121825
  derived and/or modified sequence opt2 from neuraminidase__InfluenzaB__AHZ36954

SEQ ID NO: 121844 - RNA, 1401 nt, Artificial Sequence
  derived and/or modified sequence opt2 from neuraminidase__InfluenzaB__AHZ36965
augcuccccuccaccauccagacccucacccucuuccucaccuccggcggcguccuccucucccucuacgucuccgccucccucuccuaccuccucuacuccgacauccuccucaaguucuccccccccgagaucaacgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121845 - RNA, 1404 nt, Artificial Sequence; identical to SEQ ID NO: 121825
  derived and/or modified sequence opt2 from neuraminidase__InfluenzaB__AHZ36976

SEQ ID NO: 121846 - RNA, 1404 nt, Artificial Sequence; identical to SEQ ID NO: 121825
  derived and/or modified sequence opt2 from neuraminidase__InfluenzaB__AHZ36987

SEQ ID NO: 121847 - RNA, 1401 nt, Artificial Sequence; identical to SEQ ID NO: 121828
  derived and/or modified sequence opt2 from neuraminidase__InfluenzaB__AHZ36998

SEQ ID NO: 121848 - RNA, 1401 nt, Artificial Sequence
  derived and/or modified sequence opt2 from neuraminidase__InfluenzaB__AHZ37009
augcuccccuccaccauccagacccucacccucuuccucacccucggcggcguccuccucucccucuacgucuccgccucccucuccuaccuccucuacuccgacauccuccucaaguucucccccaccgagaucaccgcccccaccaugccccucggcugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgaggccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121849 - RNA, 1401 nt, Artificial Sequence; identical to SEQ ID NO: 121826
  derived and/or modified sequence opt2 from neuraminidase__InfluenzaB__AHZ37020

SEQ ID NO: 121850 - RNA, 1401 nt, Artificial Sequence; identical to SEQ ID NO: 121828
  derived and/or modified sequence opt2 from neuraminidase__InfluenzaB__AHZ37031

SEQ ID NO: 121851 - RNA, 1401 nt, Artificial Sequence; identical to SEQ ID NO: 121826
  derived and/or modified sequence opt2 from neuraminidase__InfluenzaB__AHZ37042

SEQ ID NO: 121852 - RNA, 1401 nt, Artificial Sequence; identical to SEQ ID NO: 121828
  derived and/or modified sequence opt2 from neuraminidase__InfluenzaB__AHZ37064

SEQ ID NO: 121853 - RNA, 1401 nt, Artificial Sequence; identical to SEQ ID NO: 121826
  derived and/or modified sequence opt2 from neuraminidase__InfluenzaB__AHZ37075

SEQ ID NO: 121854 - RNA, 1401 nt, Artificial Sequence; identical to SEQ ID NO: 121826
  derived and/or modified sequence opt2 from neuraminidase__InfluenzaB__AHZ37086

SEQ ID NO: 121855 - RNA, 1401 nt, Artificial Sequence
  derived and/or modified sequence opt2 from neuraminidase__InfluenzaB__AHZ37097
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaugaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121856 - RNA, 1401 nt, Artificial Sequence; identical to SEQ ID NO: 121826
  derived and/or modified sequence opt2 from neuraminidase__InfluenzaB__AHZ37108

SEQ ID NO: 121857 - RNA, 1401 nt, Artificial Sequence
  derived and/or modified sequence opt2 from neuraminidase__InfluenzaB__AHZ41774
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggcuccaacgagugccgccacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacaacgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121858 - RNA, 1401 nt, Artificial Sequence; identical to SEQ ID NO: 120468
  derived and/or modified sequence opt2 from neuraminidase__InfluenzaB__AHZ41785

SEQ ID NO: 121859 - RNA, 1401 nt, Artificial Sequence; identical to SEQ ID NO: 120468
  derived and/or modified sequence opt2 from neuraminidase__InfluenzaB__AHZ41796

SEQ ID NO: 121860 - RNA, 1401 nt, Artificial Sequence
  derived and/or modified sequence opt2 from neuraminidase__InfluenzaB__AHZ41807
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucgagggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121861 - RNA, 1401 nt, Artificial Sequence
  derived and/or modified sequence opt2 from neuraminidase__InfluenzaB__AHZ41818
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucauggucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgucuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacauggcccucuga

SEQ ID NO: 121862 - RNA, 1401 nt, Artificial Sequence; identical to SEQ ID NO: 120468
  derived and/or modified sequence opt2 from neuraminidase__InfluenzaB__AHZ41829

SEQ ID NO: 121863 - RNA, 1401 nt, Artificial Sequence
  derived and/or modified sequence opt2 from neuraminidase__InfluenzaB__AHZ41840
augcuccccuccaccauccagaugcucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccacgccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugccgccacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggccuccaagaucggccgcugguacucccgcaccauguccaagaccgagcgcaagggcaugggccucuacgucaaguacgacggcgaccccuggaccgacuccgacgcccucgccuuccgcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121864 - RNA, 1401 nt, Artificial Sequence; identical to SEQ ID NO: 120468
  derived and/or modified sequence opt2 from neuraminidase__InfluenzaB__AHZ41851

SEQ ID NO: 121865 - RNA, 1401 nt, Artificial Sequence; identical to SEQ ID NO: 121714
  derived and/or modified sequence opt2 from neuraminidase__InfluenzaB__AHZ41862

SEQ ID NO: 121866 - RNA, 1401 nt, Artificial Sequence
  derived and/or modified sequence opt2 from neuraminidase__InfluenzaB__AHZ41873
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacgcccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121867 - RNA, 1401 nt, Artificial Sequence; identical to SEQ ID NO: 120304
  derived and/or modified sequence opt2 from neuraminidase__InfluenzaB__AIL94981

SEQ ID NO: 121868 - RNA, 1401 nt, Artificial Sequence; identical to SEQ ID NO: 120304
  derived and/or modified sequence opt2 from neuraminidase__InfluenzaB__AIL94992

SEQ ID NO: 121869 - RNA, 1401 nt, Artificial Sequence; identical to SEQ ID NO: 120329
  derived and/or modified sequence opt2 from neuraminidase__InfluenzaB__AIL95003

SEQ ID NO: 121870 - RNA, 1401 nt, Artificial Sequence
  derived and/or modified sequence opt2 from neuraminidase__InfluenzaB__AIL95014
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccgcuccgccgccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacaugacccucuga

SEQ ID NO: 121871 - RNA, 1401 nt, Artificial Sequence; identical to SEQ ID NO: 120329
  derived and/or modified sequence opt2 from neuraminidase__InfluenzaB__AIL95025

SEQ ID NO: 121872 - RNA, 1401 nt, Artificial Sequence
  derived and/or modified sequence opt2 from neuraminidase__InfluenzaB__AIL95036
augcucuccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121873 - RNA, 1401 nt, Artificial Sequence; identical to SEQ ID NO: 120329
  derived and/or modified sequence opt2 from neuraminidase__InfluenzaB__AIL95047

SEQ ID NO: 121874 - RNA, 1401 nt, Artificial Sequence; identical to SEQ ID NO: 120438
  derived and/or modified sequence opt2 from neuraminidase__InfluenzaB__AIL95058

SEQ ID NO: 121875 - RNA, 1401 nt, Artificial Sequence; identical to SEQ ID NO: 120387
  derived and/or modified sequence opt2 from neuraminidase__InfluenzaB__AIL95069

SEQ ID NO: 121876 - RNA, 1401 nt, Artificial Sequence
  derived and/or modified sequence opt2 from neuraminidase__InfluenzaB__AIL95080
augcuccccuccaccauccagacccucacccucuuccucaccuccggcggcguccuccucucccucuacgucuccgccucccucuccuaccuccucuacuccgacauccuccucaaguucucccccaaggagaucaccgcccccaccaugccccucgacugcgccaacgccuccaacguccaggccgucaaccacuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugcaacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccgacgacggcuccaucaccggccccugcgaguccaacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121877 - RNA, 1401 nt, Artificial Sequence; identical to SEQ ID NO: 120387
  derived and/or modified sequence opt2 from neuraminidase__InfluenzaB__AIL95091

SEQ ID NO: 121878 - RNA, 1401 nt, Artificial Sequence; identical to SEQ ID NO: 120329
  derived and/or modified sequence opt2 from neuraminidase__InfluenzaB__AIL95102

SEQ ID NO: 121879 - RNA, 1401 nt, Artificial Sequence
  derived and/or modified sequence opt2 from neuraminidase__InfluenzaB__AIL95113
augcuccccuccaccauccagacccucacccucuuccucaccuccggcggcguccuccucucccucuacgucuccgccucccucuccuaccuccucuacuccgacauccuccucaaguucucccccaccggcaucaccgcccccaccaugccccucgacugcgccaacgccuccaacguccaggccgucaaccgcuccgccaccaagggcgucacccuccucccccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaugaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121880 - RNA, 1401 nt, Artificial Sequence; identical to SEQ ID NO: 121826
  derived and/or modified sequence opt2 from neuraminidase__InfluenzaB__AIL95124

SEQ ID NO: 121881 - RNA, 1401 nt, Artificial Sequence
  derived and/or modified sequence opt2 from neuraminidase__InfluenzaB__AKA54777
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaccggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121882 - RNA, 1401 nt, Artificial Sequence
  derived and/or modified sequence opt2 from neuraminidase__InfluenzaB__AKA54781
augcuccccuccaccauccagacccucacccucuuccucaccuccggcggcguccuccucucccucuacgucuccgccucccucuccuaccuccucuaccucgacauccuccucaaguuccccuccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaugaaggagaucuuccccaccggccgcacccagcacaccgaggagugcaccugcggcuucgccuccaacaagaccaucgagugcgucugccgcgacaacuccuacaccgccaagcgccccuucgucaagcucaacgucgagaccgacaccgccgagauccgccucaugugcaccaagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacgucaaguacaacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 121883 - RNA, 1401 nt, Artificial Sequence
  derived and/or modified sequence opt2 from neuraminidase__InfluenzaB__AKA54783
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccucuuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121884 - RNA, 1401 nt, Artificial Sequence
  derived and/or modified sequence opt2 from neuraminidase__InfluenzaB__AKA54785
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcaacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121885 - RNA, 1401 nt, Artificial Sequence
  derived and/or modified sequence opt2 from neuraminidase__InfluenzaB__AKA54787
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121886 - RNA, 1401 nt, Artificial Sequence
  derived and/or modified sequence opt2 from neuraminidase__InfluenzaB__AKA54789
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121887 - RNA, 1401 nt, Artificial Sequence
  derived and/or modified sequence opt2 from neuraminidase__InfluenzaB__AKA54791
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacgcccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaucacccucuga

SEQ ID NO: 121888 - RNA, 1401 nt, Artificial Sequence; identical to SEQ ID NO: 121885
  derived and/or modified sequence opt2 from neuraminidase__InfluenzaB__AKA54793

SEQ ID NO: 121889 - RNA, 1401 nt, Artificial Sequence; identical to SEQ ID NO: 121885
  derived and/or modified sequence opt2 from neuraminidase__InfluenzaB__AKA54795

SEQ ID NO: 121890 - RNA, 1401 nt, Artificial Sequence; identical to SEQ ID NO: 121886
  derived and/or modified sequence opt2 from neuraminidase__InfluenzaB__AKA54797

SEQ ID NO: 121891 - RNA, 1401 nt, Artificial Sequence
  derived and/or modified sequence opt2 from neuraminidase__InfluenzaB__AKA54799
augcuccccuccaccauccagacccucacccucuuccucaccuccggcggcguccuccucucccucuacgucuccgccucccucuccuaccuccucuacuccgacauccuccucaaguucucccagaccgagaucaccgcccccaucaugccccucgacugcgccaacgccuccaacguccaggccgucaaccacuccgccgccaagggcgucacccuccuccuccccgagcccgaguggaccuacccccgccucuccugccccggcuccaccuuccagaaggcccuccucaucuccccccaccgcuucggcgagaucaagggcaacuccgccccccucaucauccgcgagcccuucaucgccugcggccccaccgagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacuccaacgcccuccucaagaucaaguacggcgaggccuacaccgacaccuaccacuccuacgagaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgagaccuaccucgacaccccccgccccaacgacggcuccaucaccggccccugcgaguccgacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucgacauggcccucuga

SEQ ID NO: 121892 - RNA, 1401 nt, Artificial Sequence; identical to SEQ ID NO: 121886
  derived and/or modified sequence opt2 from neuraminidase__InfluenzaB__AKA54801

SEQ ID NO: 121893 - RNA, 1401 nt, Artificial Sequence
  derived and/or modified sequence opt2 from neuraminidase__InfluenzaB__AKA54803
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaacggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121894 - RNA, 1401 nt, Artificial Sequence; identical to SEQ ID NO: 121886
  derived and/or modified sequence opt2 from neuraminidase__InfluenzaB__AKA54805

SEQ ID NO: 121895 - RNA, 1401 nt, Artificial Sequence
  derived and/or modified sequence opt2 from neuraminidase__InfluenzaB__AKA54807
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaucacccucuga

SEQ ID NO: 121896 - RNA, 1401 nt, Artificial Sequence
  derived and/or modified sequence opt2 from neuraminidase__InfluenzaB__AKA54809
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuucaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121897 - RNA, 1401 nt, Artificial Sequence; identical to SEQ ID NO: 121886
  derived and/or modified sequence opt2 from neuraminidase__InfluenzaB__AKA54811

SEQ ID NO: 121898 - RNA, 1401 nt, Artificial Sequence
  derived and/or modified sequence opt2 from neuraminidase__InfluenzaB__AKA54813
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccaucgaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121899 - RNA, 1401 nt, Artificial Sequence; identical to SEQ ID NO: 121886
  derived and/or modified sequence opt2 from neuraminidase__InfluenzaB__AKA54815

SEQ ID NO: 121900 - RNA, 1401 nt, Artificial Sequence
  derived and/or modified sequence opt2 from neuraminidase__InfluenzaB__AKA54817
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcgucgagaugguccacgacggcggcaagaccaccuggcacuccgccgccaccgccaucuacugccucaugggcuccggccagcuccucugggacaccgucaccggcgucaacaugacccucuga

SEQ ID NO: 121901 - RNA, 1401 nt, Artificial Sequence; identical to SEQ ID NO: 121886
  derived and/or modified sequence opt2 from neuraminidase__InfluenzaB__AKA54819

SEQ ID NO: 121902 - RNA, 1401 nt, Artificial Sequence; identical to SEQ ID NO: 121886
  derived and/or modified sequence opt2 from neuraminidase__InfluenzaB__AKA54821

SEQ ID NO: 121903 - RNA, 1401 nt, Artificial Sequence; identical to SEQ ID NO: 121886
  derived and/or modified sequence opt2 from neuraminidase__InfluenzaB__AKA54823

SEQ ID NO: 121904 - RNA, 1401 nt, Artificial Sequence; identical to SEQ ID NO: 121886
  derived and/or modified sequence opt2 from neuraminidase__InfluenzaB__AKA54825

SEQ ID NO: 121905 - RNA, 1401 nt, Artificial Sequence; identical to SEQ ID NO: 121886
  derived and/or modified sequence opt2 from neuraminidase__InfluenzaB__AKA54827

SEQ ID NO: 121906 - RNA, 1401 nt, Artificial Sequence
  derived and/or modified sequence opt2 from neuraminidase__InfluenzaB__AKA54829
augcuccccuccaccauccagacccucacccucuuccucaccuccggcggcguccuccucucccucuacgucuccgccucccucuccuaccuccucuacuccgacauccuccucaagcucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaagacccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121907 - RNA, 1401 nt, Artificial Sequence
  derived and/or modified sequence opt2 from neuraminidase__InfluenzaB__AKA54831
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccaggacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121908 - RNA, 1401 nt, Artificial Sequence; identical to SEQ ID NO: 121886
  derived and/or modified sequence opt2 from neuraminidase__InfluenzaB__AKA54833

SEQ ID NO: 121909 - RNA, 1401 nt, Artificial Sequence
  derived and/or modified sequence opt2 from neuraminidase__InfluenzaB__AKA54837
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaacggcaacuccgccccccucaucguccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcaacgagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121910 - RNA, 1401 nt, Artificial Sequence
  derived and/or modified sequence opt2 from neuraminidase__InfluenzaB__AKA54839
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaaggaggucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121911 - RNA, 1401 nt, Artificial Sequence
  derived and/or modified sequence opt2 from neuraminidase__InfluenzaB__AKA54841
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccgucaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacaucgcccucuga

SEQ ID NO: 121912 - RNA, 1401 nt, Artificial Sequence
  derived and/or modified sequence opt2 from neuraminidase__InfluenzaB__AKA54843
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccgucaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121913 - RNA, 1401 nt, Artificial Sequence
  derived and/or modified sequence opt2 from neuraminidase__InfluenzaB__AKA54845
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaacggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121914 - RNA, 1401 nt, Artificial Sequence; identical to SEQ ID NO: 121718
  derived and/or modified sequence opt2 from neuraminidase__InfluenzaB__AKA54847

SEQ ID NO: 121915 - RNA, 1401 nt, Artificial Sequence
  derived and/or modified sequence opt2 from neuraminidase__InfluenzaB__AKA54849
augcuccccuccaccauccagacccucacccucuuccucaccuccggcggcguccuccucucccucuacgucuccgccucccucuccuaccuccucuacuccgacauccuccucaaguucuccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaacggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcggcggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121916 - RNA, 1401 nt, Artificial Sequence
  derived and/or modified sequence opt2 from neuraminidase__InfluenzaB__AKA54851
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaucgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121917 - RNA, 1401 nt, Artificial Sequence
  derived and/or modified sequence opt2 from neuraminidase__InfluenzaB__AKA54853
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacgagggcuccggcggcgucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccgucaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121918 - RNA, 1401 nt, Artificial Sequence
  derived and/or modified sequence opt2 from neuraminidase__InfluenzaB__AKA54855
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucgacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121919 - RNA, 1401 nt, Artificial Sequence
  derived and/or modified sequence opt2 from neuraminidase__InfluenzaB__AKT07927
augccccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagacccgcggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccuggaccgacuccgacgcccucgccuucggcggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121920 - RNA, 1401 nt, Artificial Sequence; identical to SEQ ID NO: 120631
  derived and/or modified sequence opt2 from neuraminidase__InfluenzaB__AKT07931

SEQ ID NO: 121921 - RNA, 1401 nt, Artificial Sequence
  derived and/or modified sequence opt2 from neuraminidase__InfluenzaB__AKT07933
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121922 - RNA, 1401 nt, Artificial Sequence; identical to SEQ ID NO: 120631
  derived and/or modified sequence opt2 from neuraminidase__InfluenzaB__AKT07935

SEQ ID NO: 121923 - RNA, 1401 nt, Artificial Sequence; identical to SEQ ID NO: 120631
  derived and/or modified sequence opt2 from neuraminidase__InfluenzaB__AKT07937

SEQ ID NO: 121924 - RNA, 1401 nt, Artificial Sequence; identical to SEQ ID NO: 120473
  derived and/or modified sequence opt2 from neuraminidase__InfluenzaB__AKT07939

SEQ ID NO: 121925 - RNA, 1401 nt, Artificial Sequence; identical to SEQ ID NO: 120631
  derived and/or modified sequence opt2 from neuraminidase__InfluenzaB__AKT07941

SEQ ID NO: 121926 - RNA, 1401 nt, Artificial Sequence; identical to SEQ ID NO: 120631
  derived and/or modified sequence opt2 from neuraminidase__InfluenzaB__AKT07945

SEQ ID NO: 121927 - RNA, 1401 nt, Artificial Sequence
  derived and/or modified sequence opt2 from neuraminidase__InfluenzaB__AKT07947
augcuccccuccaccauccagacccucacccucuuccucaccuccggcggcguccuccucucccucuacgucuccgccucccucuccuaccuccucuacuccgacauccuccucaaguucucccccaccgagaucaccgcccccgccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcgucgacaugguccacgacugcggcaaggagaccuggcacuccgccgccaccgccaucuacugccucaugggcuccggccagcuccucugggacaccgucaccggcgucgacauggcccucuga

SEQ ID NO: 121928 - RNA, 1401 nt, Artificial Sequence; identical to SEQ ID NO: 121886
  derived and/or modified sequence opt2 from neuraminidase__InfluenzaB__AKU40585

SEQ ID NO: 121929 - RNA, 1401 nt, Artificial Sequence; identical to SEQ ID NO: 121886
  derived and/or modified sequence opt2 from neuraminidase__InfluenzaB__AKU40596

SEQ ID NO: 121930 - RNA, 1401 nt, Artificial Sequence
  derived and/or modified sequence opt2 from neuraminidase__InfluenzaB__AKU40607
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaccccccucgacugcgccaacgccuccaacgcccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121931 - RNA, 1401 nt, Artificial Sequence
  derived and/or modified sequence opt2 from neuraminidase__InfluenzaB__AKU40618
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaacaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121932 - RNA, 1401 nt, Artificial Sequence
  derived and/or modified sequence opt2 from neuraminidase__InfluenzaB__AKU40640
augcuccccuccaccauccagacccucacccucuuccucaccuccggcggcguccuccucucccucuacgucuccgccucccucuccuaccuccucuacuccgacauccuccucaaguucucccgcaccgagaucgccgcccccaucaugccccucgacugcgccaacgccuccaacguccaggccgucaaccgcuccgccaccaagggcgucgcccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacaacaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccaacgacggcuccaucaccggccccugcgaguccaacggcgacaagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121933 - RNA, 1401 nt, Artificial Sequence; identical to SEQ ID NO: 121886
  derived and/or modified sequence opt2 from neuraminidase__InfluenzaB__AKU40662

SEQ ID NO: 121934 - RNA, 1401 nt, Artificial Sequence
  derived and/or modified sequence opt2 from neuraminidase__InfluenzaB__AKU40673
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgaguccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121935 - RNA, 1401 nt, Artificial Sequence; identical to SEQ ID NO: 121886
  derived and/or modified sequence opt2 from neuraminidase__InfluenzaB__AKU40684

SEQ ID NO: 121936 - RNA, 1401 nt, Artificial Sequence; identical to SEQ ID NO: 121886
  derived and/or modified sequence opt2 from neuraminidase__InfluenzaB__AKU40695

SEQ ID NO: 121937 - RNA, 1401 nt, Artificial Sequence; identical to SEQ ID NO: 121886
  derived and/or modified sequence opt2 from neuraminidase__InfluenzaB__AKU40706

SEQ ID NO: 121938 - RNA, 1401 nt, Artificial Sequence; identical to SEQ ID NO: 121886
  derived and/or modified sequence opt2 from neuraminidase__InfluenzaB__AKU40717

SEQ ID NO: 121939 - RNA, 1401 nt, Artificial Sequence
  derived and/or modified sequence opt2 from neuraminidase__InfluenzaB__AKU40728
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacgcccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121940 - RNA, 1401 nt, Artificial Sequence
  derived and/or modified sequence opt2 from neuraminidase__InfluenzaB__AKU40739
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgagaccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121941 - RNA, 1401 nt, Artificial Sequence
  derived and/or modified sequence opt2 from neuraminidase__InfluenzaB__AKU40750
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaucccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121942 - RNA, 1401 nt, Artificial Sequence; identical to SEQ ID NO: 121886
  derived and/or modified sequence opt2 from neuraminidase__InfluenzaB__AKU40761

SEQ ID NO: 121943 - RNA, 1401 nt, Artificial Sequence; identical to SEQ ID NO: 121886
  derived and/or modified sequence opt2 from neuraminidase__InfluenzaB__AKU40772

SEQ ID NO: 121944 - RNA, 1401 nt, Artificial Sequence; identical to SEQ ID NO: 121886
  derived and/or modified sequence opt2 from neuraminidase__InfluenzaB__AKU40783

SEQ ID NO: 121945 - RNA, 1401 nt, Artificial Sequence
  derived and/or modified sequence opt2 from neuraminidase__InfluenzaB__AKU40794
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacaccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaaguccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121946 - RNA, 1401 nt, Artificial Sequence; identical to SEQ ID NO: 121886
  derived and/or modified sequence opt2 from neuraminidase__InfluenzaB__AKU40805

SEQ ID NO: 121947 - RNA, 1401 nt, Artificial Sequence; identical to SEQ ID NO: 121886
  derived and/or modified sequence opt2 from neuraminidase__InfluenzaB__AKU40816

SEQ ID NO: 121948 - RNA, 1401 nt, Artificial Sequence; identical to SEQ ID NO: 121886
  derived and/or modified sequence opt2 from neuraminidase__InfluenzaB__AKU40827

SEQ ID NO: 121949 - RNA, 1401 nt, Artificial Sequence; identical to SEQ ID NO: 121886
  derived and/or modified sequence opt2 from neuraminidase__InfluenzaB__AKU40838

SEQ ID NO: 121950 - RNA, 1401 nt, Artificial Sequence; identical to SEQ ID NO: 121886
  derived and/or modified sequence opt2 from neuraminidase__InfluenzaB__AKU40849

SEQ ID NO: 121951 - RNA, 1401 nt, Artificial Sequence; identical to SEQ ID NO: 121886
  derived and/or modified sequence opt2 from neuraminidase__InfluenzaB__AKU40860

SEQ ID NO: 121952 - RNA, 1401 nt, Artificial Sequence
  derived and/or modified sequence opt2 from neuraminidase__InfluenzaB__AKU40871
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucgccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucacccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121953 - RNA, 1401 nt, Artificial Sequence; identical to SEQ ID NO: 121886
  derived and/or modified sequence opt2 from neuraminidase__InfluenzaB__AKU40882

SEQ ID NO: 121954 - RNA, 1401 nt, Artificial Sequence
  derived and/or modified sequence opt2 from neuraminidase__InfluenzaB__AKU40893
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacgacggcgaccccugggccgacuccggcgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121955 - RNA, 1401 nt, Artificial Sequence; identical to SEQ ID NO: 121886
  derived and/or modified sequence opt2 from neuraminidase__InfluenzaB__AKU40904

SEQ ID NO: 121956 - RNA, 1401 nt, Artificial Sequence
  derived and/or modified sequence opt2 from neuraminidase__InfluenzaB__AKU40915
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucaugguccccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121957 - RNA, 1401 nt, Artificial Sequence; identical to SEQ ID NO: 121886
  derived and/or modified sequence opt2 from neuraminidase__InfluenzaB__AKU40926

SEQ ID NO: 121958 - RNA, 1401 nt, Artificial Sequence; identical to SEQ ID NO: 121940
  derived and/or modified sequence opt2 from neuraminidase__InfluenzaB__AKU40937

SEQ ID NO: 121959 - RNA, 1401 nt, Artificial Sequence; identical to SEQ ID NO: 121886
  derived and/or modified sequence opt2 from neuraminidase__InfluenzaB__AKU40948

SEQ ID NO: 121960 - RNA, 1401 nt, Artificial Sequence; identical to SEQ ID NO: 121886
  derived and/or modified sequence opt2 from neuraminidase__InfluenzaB__AKU40959

SEQ ID NO: 121961 - RNA, 1401 nt, Artificial Sequence; identical to SEQ ID NO: 121886
  derived and/or modified sequence opt2 from neuraminidase__InfluenzaB__AKU40970

SEQ ID NO: 121962 - RNA, 1401 nt, Artificial Sequence; identical to SEQ ID NO: 121886
  derived and/or modified sequence opt2 from neuraminidase__InfluenzaB__AKU40981

SEQ ID NO: 121963 - RNA, 1401 nt, Artificial Sequence; identical to SEQ ID NO: 121886
  derived and/or modified sequence opt2 from neuraminidase__InfluenzaB__AKU40991

SEQ ID NO: 121964 - RNA, 1401 nt, Artificial Sequence; identical to SEQ ID NO: 121886
  derived and/or modified sequence opt2 from neuraminidase__InfluenzaB__AKU41002

SEQ ID NO: 121965 - RNA, 1401 nt, Artificial Sequence; identical to SEQ ID NO: 121886
  derived and/or modified sequence opt2 from neuraminidase__InfluenzaB__AKU41013

SEQ ID NO: 121966 - RNA, 1401 nt, Artificial Sequence; identical to SEQ ID NO: 121886
  derived and/or modified sequence opt2 from neuraminidase__InfluenzaB__AKU41024

SEQ ID NO: 121967 - RNA, 1401 nt, Artificial Sequence; identical to SEQ ID NO: 120473
  derived and/or modified sequence opt2 from neuraminidase__InfluenzaB__EPI173278

SEQ ID NO: 121968 - RNA, 1401 nt, Artificial Sequence; identical to SEQ ID NO: 120473
  derived and/or modified sequence opt2 from neuraminidase__InfluenzaB__EPI498049

SEQ ID NO: 121969 - RNA, 1401 nt, Artificial Sequence; identical to SEQ ID NO: 120473
  derived and/or modified sequence opt2 from neuraminidase__InfluenzaB__AFH57913

SEQ ID NO: 121970 - RNA, 1401 nt, Artificial Sequence; identical to SEQ ID NO: 120473
  derived and/or modified sequence opt2 from neuraminidase__InfluenzaB__EPI827074

SEQ ID NO: 121971 - RNA, 1401 nt, Artificial Sequence; identical to SEQ ID NO: 120473
  derived and/or modified sequence opt2 from neuraminidase__InfluenzaB__EPI244698

SEQ ID NO: 121972 - RNA, 1401 nt, Artificial Sequence; identical to SEQ ID NO: 120473
  derived and/or modified sequence opt2 from neuraminidase__InfluenzaB__EPI244701

SEQ ID NO: 121973 - RNA, 1401 nt, Artificial Sequence; identical to SEQ ID NO: 121886
  derived and/or modified sequence opt2 from neuraminidase__InfluenzaB__EPI540672

SEQ ID NO: 121974 - RNA, 1401 nt, Artificial Sequence; identical to SEQ ID NO: 121886
  derived and/or modified sequence opt2 from neuraminidase__InfluenzaB__EPI829465

SEQ ID NO: 121975 - RNA, 1401 nt, Artificial Sequence
  derived and/or modified sequence opt2 from neuraminidase__InfluenzaB__EPI684428
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaccaugccccucgacugcgccaacgccuccaacguccaggccgucaaccgcuccaccaccaagggcgucaccccccucuuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121976 - RNA, 1401 nt, Artificial Sequence; identical to SEQ ID NO: 120495
  derived and/or modified sequence opt2 from neuraminidase__InfluenzaB__AFH58451

SEQ ID NO: 121977 - RNA, 1401 nt, Artificial Sequence; identical to SEQ ID NO: 120473
  derived and/or modified sequence opt2 from neuraminidase__InfluenzaB__EPI173280

SEQ ID NO: 121978 - RNA, 1401 nt, Artificial Sequence; identical to SEQ ID NO: 120473
  derived and/or modified sequence opt2 from neuraminidase__InfluenzaB__EPI186302

SEQ ID NO: 121979 - RNA, 1401 nt, Artificial Sequence
  derived and/or modified sequence opt2 from neuraminidase__InfluenzaB__EPI636339
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucgucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacggcggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121980 - RNA, 1401 nt, Artificial Sequence; identical to SEQ ID NO: 121979
  derived and/or modified sequence opt2 from neuraminidase__InfluenzaB__EPI645996

SEQ ID NO: 121981 - RNA, 1401 nt, Artificial Sequence
  derived and/or modified sequence opt2 from neuraminidase__InfluenzaB__EPI539770
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacgcccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccaccaucuacugccucaugggcuccggccagcuccucugggacaccgucaccggcgucaacaucacccucuga

SEQ ID NO: 121982 - RNA, 1401 nt, Artificial Sequence; identical to SEQ ID NO: 121981
  derived and/or modified sequence opt2 from neuraminidase__InfluenzaB__EPI551248

SEQ ID NO: 121983 - RNA, 1401 nt, Artificial Sequence; identical to SEQ ID NO: 121981
  derived and/or modified sequence opt2 from neuraminidase__InfluenzaB__EPI544258

SEQ ID NO: 121984 - RNA, 1401 nt, Artificial Sequence; identical to SEQ ID NO: 121886
  derived and/or modified sequence opt2 from neuraminidase__InfluenzaB__EPI592698

SEQ ID NO: 121985 - RNA, 1401 nt, Artificial Sequence; identical to SEQ ID NO: 121886
  derived and/or modified sequence opt2 from neuraminidase__InfluenzaB__EPI592706

SEQ ID NO: 121986 - RNA, 1401 nt, Artificial Sequence
  derived and/or modified sequence opt2 from neuraminidase__InfluenzaB__EPI693093
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggaguccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgccaucuacugccucaugggcuccggccagcuccucugggacaccgucaccggcgucaacaugacccucuga

SEQ ID NO: 121987 - RNA, 1401 nt, Artificial Sequence
  derived and/or modified sequence opt2 from neuraminidase__InfluenzaB__EPI678795
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcgucaccuuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucgucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaaccgcuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcaugaaguccaagaucggccgcugguacucccgcaccauguccaagaccgagcgcaugggcaugggccucuacgucaaguacggcggcaaccccugggccgacuccgacgcccucaccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121988 - RNA, 1401 nt, Artificial Sequence; identical to SEQ ID NO: 121987
  derived and/or modified sequence opt2 from neuraminidase__InfluenzaB__EPI721063

SEQ ID NO: 121989 - RNA, 1401 nt, Artificial Sequence; identical to SEQ ID NO: 120407
  derived and/or modified sequence opt2 from neuraminidase__InfluenzaB__EPI328903

SEQ ID NO: 121990 - RNA, 1401 nt, Artificial Sequence
  derived and/or modified sequence opt2 from neuraminidase__InfluenzaB__EPI543192
augcuccccuccaccauccagacccucacccucuuccucaccuccggcggcguccuccucucccucuacgucuccgccucccucuccuaccuccucuaccucgacauccuccucaaguuccccuccaccgagaucaccgcccccaccaugccccucgacugcgccaacgccuccaacguccaggccgucaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaagaucaaguacggcgaggccuacaccgacaccuaccacuccuacgccaacaacauccuccgcacccaggaguccgccugcaacugcaucggcggcaacugcuaccucaugaucaccgacggcuccgccuccggcgucuccgagugccgcuuccucaagauccgcgagggccgcaucaugaaggagaucuuccccaccggccgcacccagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucaccggccccugcgaguccaacggcggcaagggcuccggcggcaucaagggcggcuucguccaccagcgcauggccuccaagaucggccgcugguacucccgcaccauguccaagaccgagcgcaagggcaugggccucuacaucaaguacaacggcgaccccugggccgacuccgacgcccucaccuucuccggcgucauggucuccauggaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucaacaugacccucuga

SEQ ID NO: 121991 - RNA, 1401 nt, Artificial Sequence; identical to SEQ ID NO: 121990
  derived and/or modified sequence opt2 from neuraminidase__InfluenzaB__EPI500360

SEQ ID NO: 121992 - RNA, 1401 nt, Artificial Sequence
  derived and/or modified sequence opt2 from neuraminidase__InfluenzaB__EPI543186
augcuccccuccaccauccagacccucacccucuuccucaccuccggcggcguccuccucucccucuacgucuccgccucccucuccuaccuccucuacuccgacauccuccucaaguucucccgcaccgaggucaccgcccccaucaugccccucgacugcgccaacgccuccaacguccaggccgucaaccgcuccgccaccaagggcgucaccccccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccuccucaagaucaaguacggcgaggccuacaccgacaccuaccacuccuacgccaagaacauccuccgcacccaggaguccgccugcaacugcaucggcggcgacugcuaccucaugaucaccgacggccccgccuccggcaucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccaacgacggcuccaucaccggccccugcgaguccgacggcgacgagggcuccggcggcaucaagggcggcuucguccaccagcgcauggccuccaagaucggccgcugguacucccgcaccauguccaagaccaagcgcaugggcaugggccucuacgucaaguacgacggcgaccccuggaccgacuccgaggcccucgcccucuccggcgucauggucuccauggaggagcccggcugguacuccuucggcuucgagaucaaggacaagaagugcgacguccccugcaucggcaucgagaugguccacgacggcggcaagaccaccuggcacuccgccgccaccgucaucuacugccucaugggcuccggccagcuccucugggacaccgucaccggcgucaacaugacccucuga

SEQ ID NO: 121993 - RNA, 1401 nt, Artificial Sequence; identical to SEQ ID NO: 121992
  derived and/or modified sequence opt2 from neuraminidase__InfluenzaB__EPI536448

SEQ ID NO: 121994 - RNA, 1401 nt, Artificial Sequence
  derived and/or modified sequence opt2 from neuraminidase__InfluenzaB__NP_056663
augcuccccuccaccguccagacccucacccuccuccucaccuccggcggcguccuccucucccucuacgucuccgccucccucuccuaccuccucuacuccgacguccuccucaaguucuccuccaccaagaccaccgcccccaccaugucccucgagugcaccaacgccuccaacgcccagaccgucaaccacuccgccaccaaggagaugaccuuccccccccccgagcccgaguggaccuacccccgccucuccugccagggcuccaccuuccagaaggcccuccucaucuccccccaccgcuucggcgagaucaagggcaacuccgccccccucaucauccgcgagcccuucgucgccugcggccccaaggagugccgccacuucgcccucacccacuacgccgcccagcccggcggcuacuacaacggcacccgcaaggaccgcaacaagcuccgccaccucgucuccgucaagcucggcaagauccccaccgucgagaacuccaucuuccacauggccgccugguccggcuccgccugccacgacggccgcgaguggaccuacaucggcgucgacggccccgacaacgacgcccucgucaagaucaaguacggcgaggccuacaccgacaccuaccacuccuacgcccacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagauccuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucgccggccccugcgaguccaacggcgacaaguggcucggcggcaucaagggcggcuucguccaccagcgcauggccuccaagaucggccgcugguacucccgcaccauguccaagaccaaccgcaugggcauggagcucuacgucaaguacgacggcgaccccuggaccgacuccgacgcccucacccucuccggcgucauggucuccaucgaggagcccggcugguacuccuucggcuucgagaucaaggacaagaagugcgacguccccugcaucggcaucgagaugguccacgacggcggcaaggacaccuggcacuccgccgccaccgccaucuacugccucaugggcuccggccagcuccucugggacaccgucaccggcgucgacauggcccucuga

SEQ ID NO: 121995 - RNA, 1401 nt, Artificial Sequence
  derived and/or modified sequence opt2 from neuraminidase__InfluenzaB__ABG85180
augcuccccuccaccguccagacccucacccuccuccucaccuccggcggcguccuccucucccucuacgucuccgccucccucuccuaccuccucuacuccgacguccuccucaaguucuccuccaccaagaccaccgcccccaccaugucccucgagugcaccaacgccuccaacgcccagaccgucaacuacuccgccaccaaggagaugaccuuccccccccccgagcccgaguggaccuacccccgccucuccugccagggcuccaccuuccagaaggcccuccucaucuccccccaccgcuucggcgagaucaagggcaacuccgccccccucaucauccgcgagcccuucgucgccugcggccccaaggagugccgccacuucgcccucacccacuacgccgcccagcccggcggcuacuaccacggcacccgcaaggaccgcaacaagcuccgccaccucgucuccgucaagcucggcaagauccccaccgucgagaacuccaucuuccacauggccgccugguccggcuccgccugccacgacggccgcgaguggaccuacaucggcgucgacggccccgacaacgacgcccucgucaagaucaaguacggcgaggccuacaccgacaccuaccacuccuacgcccacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagauccuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucgccggccccugcgaguccaacggcgacaagggccucggcggcaucaagggcggcuucguccaccagcgcauggccuucaagaucggccgcugguacucccgcaccauguccaagaccaaccgcaugggcauggagcucuacgucaaguacgacggcgaccccuggaccgacuccgacgcccucacccucuccggcgucauggucuccaucgaggagcccggcugguacuccuucggcuucgagaucaaggacaagaagugcgacguccccugcaucggcaucgagaugguccacgacggcggcgaggacaccuggcacuccgccgccaccgccaucuacugccucaugggcuccggccagcuccucugggacaccgucaccggcaucgacauggcccucuga

SEQ ID NO: 121996 - RNA, 1401 nt, Artificial Sequence; identical to SEQ ID NO: 121885
  derived and/or modified sequence opt2 from neuraminidase__InfluenzaB__EPI376345

SEQ ID NO: 121997 - RNA, 1401 nt, Artificial Sequence; identical to SEQ ID NO: 121885
  derived and/or modified sequence opt2 from neuraminidase__InfluenzaB__EPI368424

SEQ ID NO: 121998 - RNA, 1401 nt, Artificial Sequence
  derived and/or modified sequence opt2 from neuraminidase__InfluenzaB__EPI331150
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccaugaaccgcuccgccaccaagggcgucacccuccuccuccccgagcccgaguggaccuacccccgccucuccugccccggcuccaccuuccagaaggcccuccucaucuccccccaccgcuucggcgagaccaagggcaacuccgccccccucaucauccgcgagcccuucaucgccugcggccccaacgagugcaagcacuucgcccucacccacuacgccgcccagcccggcggcuacuacaacggcacccgcggcgaccgcaacaagcuccgccaccucaucuccgucaagcucggcaagauccccaccgucgagaacuccaucuuccacauggccgccugguccggcuccgccugccacgacggcaaggaguggaccuacaucggcgucgacggccccgacaacaacgcccuccucaaggucaaguacggcgaggccuacaccgacaccuaccacuccuacgccaacaagauccuccgcacccaggaguccgccugcaacugcaucggcggcaacugcuaccucaugaucaccgacggcuccgccuccggcgucuccgagugccgcuuccucaagauccgcgagggccgcaucaucaaggagaucuuccccaccggccgcgucaagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgacaccuaccucgacaccccccgccccaacgacggcuccaucaccggccccugcgaguccgacggcgacaagggcuccggcggcaucaagggcggcuucguccaccagcgcauggaguccaagaucggccgcugguacucccgcaccauguccaagaccgagcgcaugggcaugggccucuacgucaaguacgacggcgaccccugggccgacuccgacgcccucgccuucuccggcgucauggucuccaugaaggagcccggcugguacuccuucggcuucgagaucaaggacaagaagugcgacguccccugcaucggcaucgagaugguccacgacggcggcaaggagaccuggcacuccgccgccaccgccaucuacugccucaugggcuccggccagcuccucugggacaccgucaccggcgucgacauggcccucuga

SEQ ID NO: 121999 - RNA, 1401 nt, Artificial Sequence; identical to SEQ ID NO: 121998
  derived and/or modified sequence opt2 from neuraminidase__InfluenzaB__EPI358089

SEQ ID NO: 122000 - RNA, 1401 nt, Artificial Sequence; identical to SEQ ID NO: 120144
  derived and/or modified sequence opt2 from neuraminidase__InfluenzaB__ABL76698

SEQ ID NO: 122001 - RNA, 1401 nt, Artificial Sequence
  derived and/or modified sequence opt2 from neuraminidase__InfluenzaB__AAD42328
augcuccccuccaccauccagacccucacccucuuccucaccuccggcggcguccuccucucccucuacgucuccgccucccucuccuaccuccucuacuccgacauccuccucaaguucucccccaccgagaucaccgcccccaccaugccccucgacugcgccaacgccuccaacguccaggccgucaaccgcuccgccaccaagggcaugacccuccuccuccccgagcccgaguggaccuacccccgccucuccugccccggcuccaccuuccagaaggcccuccucaucuccccccaccgcuucggcgagacccgcggcaacuccgccccccucaccauccgcgagcccuucaucgccugcggccccaaggagugcaagcacuucgcccucacccacuacgccgcccagcccggcggcuacuacaacggcacccgcgaggaccgcaacaagcuccgccaccucaucuccgucaagcucggcaagauccccaccgucgagaacuccaucuuccacauggccgccugguccggcuccgccugccacgacggccgcgaguggaccuacaucggcgucgacggccccgacuccaacgcccucaucaagaucaaguacggcgaggccuacaccgacaccuaccacuccuacgccaacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagaucuuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccgagaccuaccucgacaccccccgccccgacgacggcuccaucaccggccccugcgaguccaacggcgacaagggccgcggcggcaucaagggcggcuucguccaccagcgcauggccuccaagaucggccgcugguacucccgcaccauguccaagaccaagcgcaugggcauggagcucuacgucaaguacgacggcgaccccuggaucgacuccgacgcccucgcccccuccggcgucauggucuccauggaggagcccggcugguacuccuucggcuucgagaucaaggacaagaagugcgacguccccugcaucggcaucgagaugguccacgacggcggcaagaagaccuggcacuccgccgccaccgccaucuacugccucaugggcuccggccagcuccucugggacaccgucaccggcgucgaccgcuccgucuga

SEQ ID NO: 122002 - RNA, 1401 nt, Artificial Sequence; identical to SEQ ID NO: 121687
  derived and/or modified sequence opt2 from neuraminidase__InfluenzaB__EPI541349

SEQ ID NO: 122003 - RNA, 1401 nt, Artificial Sequence; identical to SEQ ID NO: 121886
  derived and/or modified sequence opt2 from neuraminidase__InfluenzaB__EPI541759

SEQ ID NO: 122004 - RNA, 1401 nt, Artificial Sequence; identical to SEQ ID NO: 121979
  derived and/or modified sequence opt2 from neuraminidase__InfluenzaB__EPI826201

SEQ ID NO: 122005 - RNA, 1401 nt, Artificial Sequence; identical to SEQ ID NO: 121718
  derived and/or modified sequence opt2 from neuraminidase__InfluenzaB__EPI477398

SEQ ID NO: 122006 - RNA, 1401 nt, Artificial Sequence; identical to SEQ ID NO: 121718
  derived and/or modified sequence opt2 from neuraminidase__InfluenzaB__EPI492570

SEQ ID NO: 122007 - RNA, 1401 nt, Artificial Sequence; identical to SEQ ID NO: 121718
  derived and/or modified sequence opt2 from neuraminidase__InfluenzaB__EPI498339

SEQ ID NO: 122008 - RNA, 1401 nt, Artificial Sequence; identical to SEQ ID NO: 121939
  derived and/or modified sequence opt2 from neuraminidase__InfluenzaB__EPI538118

SEQ ID NO: 122009 - RNA, 1401 nt, Artificial Sequence; identical to SEQ ID NO: 121939
  derived and/or modified sequence opt2 from neuraminidase__InfluenzaB__EPI538124

SEQ ID NO: 122010 - RNA, 1401 nt, Artificial Sequence; identical to SEQ ID NO: 121939
  derived and/or modified sequence opt2 from neuraminidase__InfluenzaB__EPI556421

SEQ ID NO: 122011 - RNA, 1401 nt, Artificial Sequence; identical to SEQ ID NO: 121939
  derived and/or modified sequence opt2 from neuraminidase__InfluenzaB__EPI614609

SEQ ID NO: 122012 - RNA, 1401 nt, Artificial Sequence; identical to SEQ ID NO: 120183
  derived and/or modified sequence opt2 from neuraminidase__InfluenzaB__BAB32609

SEQ ID NO: 122013 - RNA, 1401 nt, Artificial Sequence; identical to SEQ ID NO: 120329
  derived and/or modified sequence opt2 from neuraminidase__InfluenzaB__EPI271544

SEQ ID NO: 122014 - RNA, 1401 nt, Artificial Sequence; identical to SEQ ID NO: 120329
  derived and/or modified sequence opt2 from neuraminidase__InfluenzaB__AFH57957

SEQ ID NO: 122015 - RNA, 1401 nt, Artificial Sequence; identical to SEQ ID NO: 120329
  derived and/or modified sequence opt2 from neuraminidase__InfluenzaB__EPI294881

SEQ ID NO: 122016 - RNA, 1401 nt, Artificial Sequence; identical to SEQ ID NO: 120184
  derived and/or modified sequence opt2 from neuraminidase__InfluenzaB__ABL77259

SEQ ID NO: 122017 - RNA, 1701 nt, Artificial Sequence
  derived and/or modified sequence opt3 from hemagglutinin__InfluenzaA__AAA16879
auggaggccaagcuguucgugcucuuuugcaccuucacaguccuuaaagcugacacuaucuguguuggcuaccacgcaaacaauagcacggauaccguggacacaguacuggaaaagaacgugacugucacccauuccgugaauuuguuagaggauucucacaacgggaaacugugcucacuaaauggaauugcgccccuccagcuggguaaguguaacguugccggcuggcuucuggggaauccugaaugcgacuugcuccugacagcuaacaguuggagcuauauaaucgagaccuccaauucugaaaacggaacuuguuacccaggcgaguuuauugauuaugaggaacugagagagcaacucucgucagugagcaguuucgaaaaauuugagaucuucccgaaggccuccucuuggcccaaucaugagacaaccaagggugucacggcagccugcagcuacuccggggcuucaaguuuuuauaggaacuuacuguggauuacuaaaaagggaaccagcuacccuaaacuuucuaaguccuauacaaauaacaaaggcaaggaaguguugguacuguggggcguucaccauccacccacuaccucagagcagcagagccuauaccagaaugcagacgccuacgugagugucgggucuuccaaguauaaccggcgcuucacaccugaaaucgcugcccgaccaaaagugcguggacaagcggguagaaugaacuacuauuggacccuccuggaucagggcgacacgauaacuuuugaggcaacagggaaucuuaucgcccccugguacgcuuucgcccugaacaagggaagcgauucgggcauuaucaccucugacgcaccugugcacaauugugauacuaggugccagacaccacacggugcuuugaacuccucacucccguuucagaauguccaucccauuaccaucggggaauguccuaaauauauaaagaguacgaaacugcggauggccaccggauuacgcaacguuccaagcauucaauccagaggccuguucggcgcgaucgccggguuuauugagggagguuggacaggcaugaucgacgggugguacggauaucaccaucagaaugagcagggcucugguuacgcagcugaucaaaagagcacucagaacgccaucgacgggauuaccaauaaagugaacucaguaauagaaaagaugaauacacaguucacugcugugggcaaggaguucaacaaucucgaaaggcggaucgagaaccuuaauaaaaaggucgacgauggauuucuggacguguggaccuacaacgccgaauugcuaguucugcucgagaacgagcgcacacuggauuuccacgacaguaaugugcgaaaccuuuaugaaaaagucaagucccagcugagaaauaacgcaaaagaguugggcaaugggugcuuugaguucuaccacaagugugaugacgaaugcauggaaagggagaagaacggaaccuaugauuaccccaaauauagcgaggaaucuaagcucaaucgggaggaaauugacggugugaaacuggagucaaugggcguauaccaaaucuuagccauauauaguacuguugcuagcucccuggugcuacucgucucucugggggcgauuucguuuuggaugugcagcaacggaucccuucagugucguaucugcaucuga

SEQ ID NO: 122018 - RNA, 1701 nt, Artificial Sequence
  derived and/or modified sequence opt3 from hemagglutinin__InfluenzaA__AAA16880
auggaggccaagcuguucgugcucuuuugcaccuucacaguccuuaaagcugacacuaucuguguuggcuaccacgcaaacaauagcacggauaccguggacacaguacuggaaaagaacgugacugucacccauuccgugaauuuguuagaggauucucacaacgggaaacugugcucacuaaauggaauugcccccuugcagcuggguaaguguaacguugcgggcuggcuucuggggaauccugaaugcgacuugcuccugacagcuaacaguuggagcuauauaaucgagaccuccaauucugaaaacggaacuuguuacccaggcgaguuuauugauuaugaggaacugagagagcaacucucgucagugagcaguuucgaaaaauuugagaucuucccgaaggccuccucuuggcccaaucaugagacaaccaagggugucacggcagccugcagcuacuccggggcuucaaguuuuuauaggaacuuacuguggauuacuaaaaagggaaccagcuacccuacacuuucuaaauccuauacuaauaacaagggcaaagaaguguugguacuguggggcguucaccauccacccaccgugaaugagcagcagucacuauaccagaacgcagacgccuacgucagcguggggaguucuaaguauaaccggcgcuucacaccugaaaucgcugcccgaccaaaggugcguggacaagcggguagaaugaauuaccacuggacccuccuggaucagggcgacacgauaacuuuugaggcaacagggaaccuuaucgcccccugguaugcuuucgcccugaauaaaggauccgauagcggcauuaucaccucggacgcaccuguccacaacugugauacuaggugccagacaccacauggugcucucaauucuucccucccguuucagaacguucaccccauuaccaucggggaauguccuaaguacgugaaaucaacgaagcugcggauggccaccggauuacgcaauguaccaaguauacaaagcagaggccuguucggcgcgauugccggguuuaucgagggagguuggacaggcaugauugacgggugguauggauaccaucaccagaacgagcagggcuccgguuaugcagcugaucagaaaucuacucaaaaugccaucgacgggaucaccaacaaggugaauagcgucauugaaaagaugaacacaaaauucacugcugugggcaaggaguucaauaaccucgaaaggcggauagagaaucuuaacaaaaagguugacgauggauuucuggacguguggaccuacaacgccgaauugcuaguccugcucgagaaugagcgcacacuggauuuccacgacucaaacgugcgaaaucuuuacgaaaaaguaaagagucagcugagaaacaaugcaaaagaguugggcaacgggugcuuugaguucuaucauaagugugaugacgaaugcaucgaauccguuaagaauggaaccuacgauuaucccaaauacagcgaggagucuaagcucaacagggaagagauugacggugugaaacuggaaucaaugggcgucuaucagaucuuagccauauacaguacuguggcuagcucccugguccuacucgugucucugggggcgauuucguuuuggaugugcagcaauggaucccuucaaugucggaucugcaucuga

SEQ ID NO: 122019 - RNA, 1689 nt, Artificial Sequence
  derived and/or modified sequence opt3 from hemagglutinin__InfluenzaA__AAA64362
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaaguaucugcucagcuccgugaagcauuucgaaaaagucaagauuuuaccaaaagaucgauggacucaacacaccacaaccgggggaucucgugcuugugccgugucgggcaaccccucauuuuucagaaauaugguuuggcugacuaagaaaggcagcgacuacccuguggcaaaggggaguuauaacaauacauccggagagcagaugcuuaucauuugggguguccaucacccaaacgaugagaccgaacagaggacguuguaccagaaugugggcacuuacguaucuguugggaccagcacacugaacaagcgguccacucccgagaucgccacccgcccuaaagugaauggacuaggcucaagaauggaauuuaguuggacacuccuggacaugugggauaccauaaacuucgagagcacggguaaccuuauugcuccagaauauggguuuaagaucucuaaaaggggauccucaggcauuaugaagacugagggcacacuggagaauugcgaaaccaaaugucaaacuccguugggggcaaucaacacaacccuccccuuccacaauguccauccucugacgaucggagagugcccacgguacgugaagucggaaaaauuagugcuggccaccggucuccgcaacgucccccagauugagagucgaggccuuuuuggggcuauagccggauucaucgaaggcgguuggcaggggaugguugacggcugguauggauaccaccauucuaaugaucagggcuccggguaugcggcagacaaggagagcacacaaaaggccuuugacggaauuacuaacaaagugaauagcguaaucgagaagaugaacacccaguucgaagcuguggguaaagaguuuucuaaucuggaaagaagguuggagaaccuaaauaagaaaauggaagauggcuuccuggacgucuggacauacaacgccgagcuccuggugcuuauggagaaugaacggacucuggauuuccacgacuccaacguuaagaauuuguaugauaaggugcguaugcagcuccgcgacaacgucaaagagcuggggaacggauguuuugaguucuaccacaagugcgaugacgaguguaugaacucagugaaaaauggcaccuacgauuauccuaaguacgaggaagagaguaaauuaaauagaaacgaaauaaaggguguaaagcugagcuccauggggguuuaucagauucuagcaaucuacgcuacaguggccggcucucucagccuggcgaucaugauggccggaauuucauuuuggaugugcaguaauggcucccuucaaugcaggaucuguauuuga

SEQ ID NO: 122020 - RNA, 1689 nt, Artificial Sequence
  derived and/or modified sequence opt3 from hemagglutinin__InfluenzaA__AAA64363
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguugggaccagcacacugaauaagcgguccacucccgauaucgccacccgcccuaaagugaacggacaaggcgguagaauggaguuuucauggacacuacucgacaugugggauaccauaaacuucgaaaguacggggaaucugauugcuccagaguacggauuuaagaucagcaaaagggggucuuccggcauuaugaagacugaaggcacacuuggaaacugcgagaccaaaugucagacuccgcugggugcaaucaauacaaccuugcccuuccauaacguccacccucucacgaucggcgagugcccaaaguaugugaaaucagaaaagcugguguuagccaccgggcugcggaaugucccccagauugagagccgcggacucuuuggcgcuauagccgguuucaucgaagggggcuggcagggaaugguugacggcugguacggguaucaucacaguaacgaucaaggaucugguuacgcggcagacaaggaguccacacagaaagccuuugacggcauuacuaauaaggugaacagcguaaucgagaaaauaaauacccaguucgaggcuguggagaaggaauuuucgaaccuugagcgaagacuggaaaauuugaacaaaaagauggaggauggguuccuagacgucuggacauauaaugccgaacugcucgugcugauggagaacgagaggacucuugauuuccacgacucuuccguuaagaaucuguacgauaaagugcggaugcaguugcgugacaacgucaaggaacucggaaacggcuguuuugaguucuaucauaaaugcgaugacgaauguaugaacucagugaagaaugguaccuacgauuacccuaaauaugaggaggaaaguaagcugaaucgcaacgagauuaaggggguaaaauuaagcuccaugggcaucuaccaaauccuggcaauuuaugcuacaguugccggaucucuaagccucgcgaucaugauggccggcauuucauuuuggaugugcaguaaugggucccugcagugcagaauauguaucuga

SEQ ID NO: 122021 - RNA, 1689 nt, Artificial Sequence
  derived and/or modified sequence opt3 from hemagglutinin__InfluenzaA__AAA64365
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguugggaccagcacacugaauaagcgguccacucccgauaucgccacccgcccuaaaguggacggacuaggcucaagaauggaguuuaguuggacacuccuggauaugugggacaccauaaacuucgaaagcacggguaaccuuauugcuccagaguacggguuuaagaucucuaaaaggggauccucaggcauuaugaagacugaaggcacacuggggaauugcgagaccaaaugucaaacuccguugggagcaaucaacacaacccuccccuuccauaauguccacccucugacgaucggugagugcccaaaguaugugaaaagcgaaaaguuagugcuggccaccggccuccggaacgucccccagauugagagucgcgggcuuuuuggagcuauagccggcuucaucgaagguggguggcagggcaugguugauggaugguacggcuaucaucacucuaaugaccagggguccggauacgcggcagacaaggagagcacacaaaaagccuuugaugguauuacuaacaagguaaauucggugaucgagaaaaugaacacccaguucgaggcuguggagaaggaauuuucuaaucuggagcgaagauuggaaaaccuaaauaaaaagauggaggacggcuuccuggaugucuggacauauaacgccgaacuccuggugcuuauggagaaugagaggacucuggacuuccacgauuccaacguuaagaauuuguacaacaaagugcggaugcagcuccgugacaacgucaaggaacuggggaauggauguuuugaguucuaucauaaaugcgaugacgaauguaugaacucagugaagaauggcaccuacgauuacccuaaauaugaggaggaaaguaaguuaaaccgcaaugagauaaaggguguaaaacugagcuccauggggauuuaccagauccuagcaaucuaugcuacaguugccggcucucucagccuggcgauuaugauggccggaaucucauuuuggaugugcaguaacggcucccuucaaugcagaauuuguauauga

SEQ ID NO: 122022 - RNA, 1689 nt, Artificial Sequence
  derived and/or modified sequence opt3 from hemagglutinin__InfluenzaA__AAA64366
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaagagagcaacuauccuguggcaaagggcaguuacaauaacacauccggggagcagaugcuuaucauuuggggaguccaccacccaaaugacgaaaccgagcagaggacguuguaucagaacguggguacuuacguaucuguuggcaccagcacacugaauaagcgguccacucccgauaucgccacccgcccuaaagugaacgggcuaggaucaagaauggaauuuaguuggacacuccuggacaugugggauaccauaaacuucgagagcacgggcaaucuuauugcuccagaauacgguuuuaagaucucuaaaaggggguccucaggaauuaugaagacugagggcacacuggagaacugcgaaaccaaaugucaaacuccguugggcgcaaucaauacaacccuccccuuccauaacguccacccucugacgaucggggagugcccaaaguaugugaaaagcgaaaaguuagugcuggccaccggacuccggaaugucccccagauugagagucgcggucuuuuuggcgcuauagccggguucaucgaaggaggcuggcaggguaugguugacgggugguacggcuaucaucacucuaacgaucagggauccggcuacgcggcagacaaggagagcacacaaaaagccuuugacgggauuacuaauaaggugaacucgguaaucgagaaaaugaauacccaguucgaagcugugggaaaggaguuuucuaaccuggaacgaagauuggagaaucuaaacaaaaagauggaagaugguuuccuggacgucuggacauauaaugccgagcuccuggugcuuauggagaacgaaaggacucuggauuuccacgacuccaauguuaagaacuuguacgauaaagugcggaugcagcuccgugacaacgucaaggagcugggcaauggguguuuugaguucuaucauaaaugcgaugacgaguguaugaacucagugaagaauggaaccuacgauuacccuaaauaugaggaagagaguaaguuaaaccgcaaugaaauaaagggcguaaaacugagcuccauggguguuuaccagauucuagcaaucuaugcuacaguggccgggucucucagccuggcgaucaugauggccggcauuucauuuuggaugugcaguaacggaucccuucaaugcagaaucuguauuuga

SEQ ID NO: 122023 - RNA, 1701 nt, Artificial Sequence
  derived and/or modified sequence opt3 from hemagglutinin__InfluenzaA__AAA85781
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacaggauucuagacggcaucaacuguacccucauagaugcucugcuuggggacccgcauugcgauggauuccagaaugagaaaugggaccuguuuguggaaagaagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaacggguuuuucucucgacugaauuggcucuacaagagcggauccacguaucccgugcaaaacgucacuaugccuaauaacgacaacucagauaaguuauacauuuggggugugcaccauccaaguaccgacaaagagcagacaaaucuguauguacaggcaagcggcaagguuacugugucuaccaaacguucccagcaaacagucauccccaacguggggucaagaccuugggugaggggacuuagcagucgggucucuauuuacuggaccaucguuaagccaggcgacauauuggugauuaauuccaacgguaaucugaucgccccgcgcggguacuauaaaaugagaacgggaaagagcucgauuaugaggucugaugcucccaucggcacuuguuccucagagugcaucacaccuaacggcaguauuccaaaugacaagcccuuucagaacguaaauaaaauaaccuacggggccuguccuaaguaugugaaacagaacacucuaaagcucgcgacaggaaugcggaaugucccagaaaaacagauccgcgguauuuucggcgcaaucgccggguuuauagagaacggaugggaaggcaugauugaugguugguacggguuccgacaccaaaauagcgagggcaccggacaggcugccgaccugaaguccacgcaggcagcuaucgaucaaaucaacggcaaacuuaauagagugauugagaagaccaacgaaaaguuucaccagaucgagaaagaguucucugaaguugaagggaggauucaggaccuggagaaguauguggaggauacaaaaauagacuuguggagcuacaacgccgaacuccuggucgcguuagagaaucagcauacuaucgaucugaccgacucagaaaugaacaaacucuucgagaagacacggcgucaacuucgcgaaaaugccgaggauaugggaaacgguugcuuuaagauuuaucacaagugugacaaucccugcaucggcaguaucagaaacgggacuuacgaccaugauguguacagggacgaggcacugaauaaccgguuccagauuaaaggaguagaauugaaguccggcuauaaagauuggauacuauggaucagcuuugcuauuucuugcuuccugcucuguguugugcugcuugguuuuaucaugugggccugccagaaggggaauauucgauguaacaucugcauauga

SEQ ID NO: 122024 - RNA, 1707 nt, Artificial Sequence
  derived and/or modified sequence opt3 from hemagglutinin__InfluenzaA__AAC14418
auggagagaaucgugcugcuccuugccaccgucagccugguuaaguccgaccagauuugcauaggcuaccacgcuaacaauucuacagaacaaguggauacuaucauggagaaaaacguaacggugacccaugcacaggacauuuuggaaaggacacacaaugggaaguuaugugaucugaacggagucaaaccccuaauccuccgggacugcucaguggccgguuggcugcuuggcaauccuaugugugaugaguucauuaacguuccagaauggaguuauaucguggagaaggcgagcccggcuaaugaccugugcuaccccgggaacuuuaaugauuaugaggaauugaaacaucuccugucccgcauaaaccacuucgagaagauccagauuaucccuaagucuucguggucaaaucaugacgccagcaguggagucuccucugcauguccauaccugggccgaagcuccuuuuuccguaacgugguauggcucauuaaaaagaacucaacuuaucccaccaucaaaagaaguuacaauaauacaaaccaggaagauuuacugguucuuugggguauacaccacccuaacgacgccgcugagcaaaccaaguuguaucagaauccaacuacauacauuagcguggggaccucuacgcugaaccagaggcuaguccccgagaucgcaacucggccuaaagugaauggacaguccggccgcauggaauuuuucuggaccauucucaagccaaacgaugccaucaauuuugagucaaacggcaauuucaucgcuccggaauacgccuauaagauugugaaaaagggggacagcacaauaaugaaaagugagcuggaauacggaaacugcaauacuaagugucaaacccccaugggugcgaucaacucuuccaugccuuuucauaauauucacccacuuacaaucggcgagugccccaaauaugucaagagcaacagacugguuuuggcaaccgggcucaggaaugccccucagcgggagcgccgaaggaaaaagagaggacuguucggcgcuauagccgguuuuauugaagggggauggcagggcaugguggauggcugguacggguaucaucacucgaacgagcagggaucugguuacgcagcugaccaagaauccacgcagaaggccaucgacggcguaacuaauaaagugaacucaaucauuaacaagaugaauacacaguucgaggcggucgggcgggaauuuaacaauuuagagcgucgcaucgagaaccugaauaaaaagauggaagauggauuccucgacguguggaccuauaacgccgagcuucugguuuugauggaaaaugagagaacucuagauuuccacgacaguaacgugaaaaaucuguacgauaaggucaggcuccaacugcgggacaacgcaaaggaacuuggcaaugguuguuuugaguucuaccauaaaugcgauaacgaguguauggaaagcgugaagaaugggacauaugacuacccacaguauuccgaggaagcucgacugaaccgcgaggagauuucuggcguaaaauuggaaagcaugggaaccuaccagauacucucaaucuauaguacgguugccuccagccuggcuuuagccauuaugguggcaggccugucucuauggaugugcucaaaugggagucuccagugcagaaucuguaucuga

SEQ ID NO: 122025 - RNA, 1707 nt, Artificial Sequence
  derived and/or modified sequence opt3 from hemagglutinin__InfluenzaA__AAC40508
auggagagaaccgugcugcuccuugccacagucagccugguuaaguccgaccagaucugcauuggcuaccacgcuaacaauucuacugaacaaguggauacgauaauggagaaaaacguaaccgugacacaugcacaggacaucuuggaaaggacucacaaugggaaguuaugugaucugaacggagucaaaccccuaauucuccgggacugcucaguggccgguuggcugcuuggcaauccuaugugugaugaguucaucaacguuccagaauggaguuauauuguggagaaggcgagcccggcuaaugaccugugcuaccccgggaacuuuaaugauuaugaggaauugaaacaucuccugucccgcaucaaccacuucgagaagauacagaucauuccuaagucuucguggucaaaucaugacgccagcaguggagucuccucugcauguccauaccugggccgaagcuccuuuuuccguaacgugguauggcucaucaaaaagaacucagccuaucccaccauuaaaagaaguuacaauaauacaaaccaggaagauuuacugguucuuuggggugugcaccacccuaacgacgcugcagagcaaaccaaguuguaucagaauccaacuacauacaucagcgucgggaccucuacgcugaaccagaggcuagugcccgagauagccacucggccuaaagugaauggacaguccggccgcauggaauuuuucuggaccauucucaagccaaacgaugcuaucaauuuugagucaaacggcaauuucauugccccggaauacgcguauaagaucgucaaaaagggggacagcacaaucaugaaaagugagcuggaauacggaaacugcaauacuaagugucaaacccccaugggugcaauuaacucuuccaugccuuuucauaauauacacccacuuacaaucggcgagugccccaaauauguuaagagcaacagacugguguuggccaccgggcucaggaauacgccucagcgggagcgccgaaggaaaaagagaggacuguucggcgcuauugccgguuuuaucgaagggggauggcagggcaugguagauggcugguacggguaucaucacucgaacgagcagggaucuuguuacuccgcagacaaggaaucaacucaaaaagcuauagacggugugacaaauaaggucaacaguauuaucaacaaaaugaauacccaguucgaggccgugggccgggaauuuaacaauuuagagcgucgcaucgagaaccugaauaagaaaauggaagauggguuccucgacguuuggacuuauaacgcggagcuucugguguugauggaaaaugagagaacacuagauuuccacgacagcaacgucaagaaucuguacgauaaggugaggcuccagcugcgggacaacgccaaagaacuuggaaauggcugcuuugaguucuaccauaagugugauaacgagugcauggaauccguuaaaaaugguaccuaugacuacccacaauauucugaggaagcacgacugaaccgcgaggagauuagcgggguaaaguuggaaucaaugggcacguaccagauccucaguauuuauuccaccguggcuagcucucuggccuuagcuauaauggucgccggacugucacuauggaugugcaguaauggcagccuccaguguagaaucugcauuuga

SEQ ID NO: 122026 - RNA, 1701 nt, Artificial Sequence
  derived and/or modified sequence opt3 from hemagglutinin__InfluenzaA__AAF87274
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaaaauagacacaacgggaagcuauguaaacucaagggaguggcgccccugcaucuugguaaaugcaauauagcuggcuggcuguuggggaacccugagugugaacuccuguuuaccgccucuucauggaguuacaucguugagacuagcaauuccgauaacggaacaugcuauccaggcgacuucauuaauuacgaagaacugagggagcagcucucuucggugaguagcuuugaacgguucgagaucuuuccgaaggcaaacaguuggcccaaucacgaaaccaaccgcggugucacguccgccuguccuuaugcuggggcaaauucuuucuaccgaaacuuaauuuggcuggugaagaaaggaaacagcuauccaaaacuuuccaagucauacaucaauaacaagggcaaagagguauugguucuguggggcauacaucaucccccuacuucaaaugaucaacagagccuauaccagaacgccgacgcuuauguguuugucgggucuuccaaguacaauaagaaauucaugccagagaucgccacccgucccaaggugagaggacaggcggguaggaugaacuauuacuggacacucauugaaccuggcgauacuaucaccuuugaggcaacagggaaucugguggccccacgguaugcuuucgccauggaacgcggaucaggcagcgguauuaucauaagugacaccccgguccacgauugcaacgcaacgugucaaacucccaaaggggcuauuaauacaaaccuuccuuuucagaauauccacccaguuaccauuggagagugccccaaguacgugaaaucuacuagacugaggauggccacaggcuugcggaacaucccuuccauccagagccgcggccucuucggggcgauugccggauuuauagaagguggcuggaccgggaugaucgacggaugguauggcuaccaccaucagaaugagcaagguucgggguacgcagcugaucgaaagucuacgcagaacgccauugacggcaucaccaauaaaguaaacuccgugauagagaagaugaacacacaguucacugcugucggaaaggaguucaaucaccuggagaaaagaauuaagaacuuaaauaaaaagguggaugacggcuuucuggacguuuggaccuauaacgccgaacuccuugugcuguuggagaaugaaaggacacuagauuaccacgacucaaacgucaaaaaucuguaugagaaggugcggagucagcuccguaacaaugcaaaggagaucgggaacggauguuucgaauuuuaccauaaaugcgaugacacuuguauggagagcaucaagaaugguaccuaugauuacccaaaauauuccgaagaggccaagcugacacgcgaagagauugacggcguaaaacuugagucuaccagaaucuaccaaauucuggcuauauacagcacuaucgcgucaaguuugguucuccugguguccuuaggggcaauuagcuucuggaugugcucuaacggaucacugcagugcaggaucuguaucuga

SEQ ID NO: 122027 - RNA, 1701 nt, Artificial Sequence
  derived and/or modified sequence opt3 from hemagglutinin__InfluenzaA__AAF87275
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaaaauagacacaacgggaagcuauguaaacucaagggaguggcgccccugcaucuugguaaaugcaauauagcuggcuggcuguuggggaacccugagugugaacuccuguuuaccgccucuucauggaguuacaucguugagacuagcaauuccgauaacggaacaugcuauccaggcgacuucauuaauuacgaagaacugagggagcagcucucuucggugaguagcuuugaacgguucgagaucuuuccgaaggcaaacaguuggcccaaucacgaaaccaaccgcggugucacguccgccuguccuuaugcuggggcaaauucuuucuaccgaaacuuaauuuggcuggugaagaaaggaaacagcuauccaaaacuuuccaagucauacaucaauaacaagggcaaagagguauugguucuguggggcauacaucaucccccuacuucaaaugaucaacagagccuauaccagaacgccgacgcuuauguguuugucgggucuuccaaguacaauaagaaauucaugccagagaucgccacccgucccaaggugagaggacaggcggguaggaugaacuauuacuggacacucauugaaccuggcgauacuaucaccuuugaggcaacagggaaucugguggccccacgguaugcuuucgccauggaacgcggaucaggcagcgguauuaucauaagugacaccccgguccacgauugcaacgcaacgugucaaacucccaaaggggcuauuaauacaaaccuuccuuuucagaauauccacccaguuaccauuggagagugccccaaguacgugaaaucuacuagacugaggauggccacaggcuugcggaacaucccuuccauccagagccgcggccucuucggggcgauugccggauuuauagaagguggcuggaccgggaugaucgacggaugguauggcuaccaccaucagaaugagcaagguucgggguacgcagcugaucgaaagucuacgcagaacgccauugacggcaucaccaauaaaguaaacuccgugauagagaagaugaacacacaguucacugcugucggaaaggaguucaaucaccuggagaaaagaauugaaaacuuaaauaagaaaguggaugacggcuuucuggacguuuggaccuauaacgccgagcuccuugugcuguuggaaaaugagaggacacuagauuaccacgacucaaacgucaagaaucuguaugagaaagugcggagucagcuccguaacaaugcaaaggaaaucgggaacggauguuucgaguuuuaccauaagugcgaugacacuuguauggaaagcaucaaaaaugguaccuaugauuacccaaaguauuccgaggaagccaaacugacacgcgaggagauugacggcguaaaacuugaaucuaccagaaucuaccaaauucuggcuauauacagcacuaucgcgucaaguuugguucuccugguguccuuaggggcaauuagcuucuggaugugcucuaacggaucacugcagugcaggaucuguaucuga

SEQ ID NO: 122028 - RNA, 1701 nt, Artificial Sequence
  derived and/or modified sequence opt3 from hemagglutinin__InfluenzaA__AAF87277
augaaggccauccugcucgugcuucuguacaccuucacagcugcaaacgccgacacuuugugcauuggcuaucacgcgaauaacagcacggauaccgucgacacaguuuuagagaagaaugugacuguaacccauuccgugaaccugcuagaagauagacacaaugggaagcucuguaaacugaggggaauagcuccccuucaucuggguaagugcaacaucgccggcugguugcucgggaauccugagugugaacugcuguuuacagcaucuucauggaguuacauugucgagaccagcaacuccgacaauggaacuugcuauccaggcgauuucaucaacuacgaagaacuccgggagcaguuaucuucggugucuagcuuugaacgcuucgagauuuuuccgaaagccaguuccuggcccgaccacgaaacaaaucgagguguuaccgcugcauguccuuaugccggggcuaacucuuucuaccguaaucugaucuggcuugugaagaagggaaacagcuauccaaaauuguccaagucauacauaaauaacaaagagaaggagguccuggugcuauggggcauccaucaucccccuacgaguacugaucaacagagccucuaccagaacgccgacgcguauguauuuguuggcucauccaaauacaauaagaaguucaaaccagaaauugcaucaagacccaaggugagggggcaggccggacggauggauuauuacuggacccuggucgagccuggugacacaaucacuuuugaagcuaccggcaaccuuguggugccacgcuaugccuucgcaaugaaaagagggagcggaaguggcauuaucauaucugauacaccgguccacgacugcaauaccacgugucaaacucccaagggugcuauuaacacaucccugccuuuucagaauauccacccaguuaccauuggggagugccccaaauacguaaagagcacuaaauugaggauggccacaggacuccggaacaucccuucgauccagucucgcggccuguucggcgcgauugccggguuuauagaaggagguuggaccggcaugaucgaugggugguauggauaccaccaucagaaugagcaaggcuccgguuacgcagcugaccgaaagucaacgcagaacgccauugacggggugaccaauaaggugaacagugucaucgagaaaaugaauacacaguucacugcugugggcaaggaguucaaccacuuagagaaaagaauagaaaaucugaacaagaaaguugaugacggauuucucgauguguggaccuauaaugccgagcuucuggucuugcuagaaaacgagaggacacuggacuaccacgauagcaacgugaagaaucucuaugagaagguacggucccagcugaaaaacaaugcaaaggaaauuggcaacggguguuucgaguuuuaccauaaaugcgacgauacuuguauggaaucuguuaagaauggaaccuaugacuacccaaaauauagcgaggaaucaaaacuuaaccgugaggagaucgauggugugaagcuggaaaguacacgcaucuaccaaauuuuggccaucuacuccaccgucgcuagcucucucauucuguuagugucacugggcgcgauaaguuucuggaugugcagcaaugggucccuacagugcagaaucuguauuuga

SEQ ID NO: 122029 - RNA, 1701 nt, Artificial Sequence
  derived and/or modified sequence opt3 from hemagglutinin__InfluenzaA__AAF87278
augaaggccauccugcucgugcuucuguacaccuucacagcugcaaacgccgacacuuugugcauuggcuaucacgcgaauaacagcacggauaccgucgacacaguuuuagagaagaaugugacuguaacccauuccgugaaccugcuagaagauagacacaaugggaagcucuguaaacugaggggaauagcuccccuucaucuggguaagugcaacaucgccggcugguugcucgggaauccugagugugaacugcuguuuacagcaucuucauggaguuacauugucgagaccagcaacuccgacaauggaacuugcuauccaggcgauuucaucaacuacgaagaacuccgggagcaguuaucuucggugucuagcuuugaacgcuucgagauuuuuccgaaagccaguuccuggcccaaucacgaaacaaaccgagguguuaccgcugcauguccuuaugccggggcuaauucuuucuaccguaaccugaucuggcuugugaagaagggaaauagcuauccaaaauuguccaagucauacauaaacaacaaagagaaggagguccuggugcuauggggcauccaucaucccccuacgaguacugaccaacagagccucuaccagaaugccgaugcguauguauuuguuggcucauccaaauacaacaagaaguucaaaccagaaauugcaucaagacccaaggugagggggcaggccggacggauggacuauuacuggacccuggucgagccuggugauacaaucacuuuugaagcuaccggcaaucuuguggugccacgcuaugccuucgcaaugaaaagagggagcggaaguggcauuaucauaucugacacaccgguccacgauugcaacaccacgugucaaacucccaagggugcuauuaauacaucccugccuuuucagaacauccacccaguuaccauuggggagugccccaaauacguaaagagcacuaaauugaggauggccacaggacuccggaauaucccuucgauccagucucgcggccuguucggcgcgauugccggguuuauagaaggagguuggaccggcaugaucgacgggugguauggauaccaccaucagaacgagcaaggcuccgguuacgcagcugaucgaaagucaacgcagaaugccauugacggggugaccaacaaggugaauagugucaucgagaaaaugaacacacaguucacugcugugggcaaggaguucaaucacuuagagaaaagaauagaaaaccugaauaagaaaguugacgauggauuucucgacguguggaccuauaacgccgagcuucuggucuugcuagaaaacgagagggcacuggauuaccacgacagcaaugugaagaaccucuaugagaagguacggucccagcugaaaaauaacgccaaggaaauuggcaauggguguuucgaguuuuaccauaaaugcgaugacacauguauggaaucuguuaagaacggaacuuaugauuacccaaaauauagcgaggaaucaaaacuuaaucgugaggagaucgacggugugaagcuggaaaguacccgcaucuaccaaauuuuggcuaucuacuccacagucgcgagcucucucauucuguuagugucacugggcgcaauaaguuucuggaugugcagcaacgggucccuacagugcagaaucuguauuuga

SEQ ID NO: 122030 - RNA, 1701 nt, Artificial Sequence
  derived and/or modified sequence opt3 from hemagglutinin__InfluenzaA__AAF87279
augaaggccauccugcucgugcuucuguacaccuucacagcugcaaacgccgacacuuugugcauuggcuaucacgcgaauaacagcacggauaccgucgacacaguuuuagagaagaaugugacuguaacccauuccgugaaccugcuagaagauagacacaaugggaagcucuguaaacugaggggaauagcuccccuucaucuggguaagugcaacaucgccggcugguugcucgggaauccugagugugaacugcuguuuacagcaucuucauggaguuacauugucgagaccagcaacuccgacaauggaacuugcuauccaggcgauuucaucaacuacgaagaacuccgggagcaguuaucuucggugucuagcuuugaacgcuucgagauuuuuccgaaagccaguuccuggcccaaucacgaaacaaaccgagguguuaccgcugcauguccuuaugccggggcuaauucuuucuaccguaaccugaucuggcuugugaagaagggaaauagcuauccaaaauuguccaagucauacauaaacaacaaagagaaggagguccuggugcuauggggcauccaucaucccccuacgaguacugaccaacagagccucuaccagaaugccgaugcguauguauuuguuggcucauccaaauacaacaagaaguucaaaccagaaauugcaucaagacccaaggugagggggcaggccggacggauggacuauuacuggacccuggucgagccuggugauacaaucacuuuugaagcuaccggcaaucuuguggugccacgcuaugccuucgcaaugaaaagagggagcggaaguggcauuaucauaucugacacaccgguccacgauugcaacaccacgugucaaacucccaagggugcuauuaauacaucccugccuuuucagaacauccacccaguuaccauuggggagugccccaaauacguaaagagcacuaaauugaggauggccacaggacuccggaauaucccuucgauccagucucgcggccuguucggcgcgauugccggguuuauagaaggagguuggaccggcaugaucgacgggugguauggauaccaccaucagaacgagcaaggcuccgguuacgcagcugaucgaaagucaacgcagaaugccauugacggggugaccaacaaggugaauagugucaucgagaaaaugaacacacaguucacugcugugggcaaggaguucaaucacuuagagaaaagaauagaaaaccugaauaagaaaguugacgauggauuucucgacguguggaccuauaacgccgagcuucuggucuugcuagaaaacgagaggacacuggauuaccacgacagcaaugugaagaaccucuaugagaagguacggucccagcugaaaaauaacgcaaaggaaauuggcaauggguguuucgaguuuuaccauaaaugcgaugacacuuguauggaaucuguuaagaacggaaccuaugauuacccaaaauauagcgaggaaucaaaacuuaaucgugaggagaucgacggugugaagcuggaaaguacacgcaucuaccaaauuuuggccaucuacuccaccgucgcuagcucucucauucuguuagugucacugggcgcgauaaguuucuggaugugcagcaacgggucccuacagugcagaaucuguauuuga

SEQ ID NO: 122031 - RNA, 1701 nt, Artificial Sequence
  derived and/or modified sequence opt3 from hemagglutinin__InfluenzaA__AAF87281
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauagacacaaugggaagcuauguaaacucaagggaauagcgccccugcaucuugguaaaugcaacaucgcuggcuggcuguuggggaauccugagugugaacuccuguuuaccgccucuucauggaguuacauuguggagacuagcaacuccgacaauggaacaugcuauccaggcgauuucaucaacuacgaggaacugagggagcagcucucuucgguuagcucauuugaacgguucgagauuuuuccgaaggcaaguuccuggcccaaucacgaaaccaaccgcggugugacgucugccuguccuuaugcuggggcaaauagcuucuaccgaaacuuaaucuggcuggucaagaaaggaaauuccuauccaaaacuuucaaaaaguuacauaaacaacaagggcaaaaagguguugguacuguggggcauccaucaucccccuacuagcaccgaccaacagucucuauaccagaaugccgaugcuuauguuuuugugggguccucaaaguacaacaaaaaguucaugccagagauugccacacgucccaaagucagaggacaggcggguaggaugaauuauuacuggacucucaucgagccuggcgacaccauuacauuugaagcaaccgggaaccugguggugccacgguaugccuucgcuauggagcgcggauacggcagcgguaucauaauuagugauacgccgguccacgacugcaauacuacaugucaaacccccaagggggccaucaacacuucucuuccuuuucagaauauucacccaguuacaaucggagaaugccccaaauaugugaaguccaccaaacugagaauggcaacgggcuugaggaacaucccuagcauucagucgcggggccucuucggggcuauagccggauuuaucgaggguggcuggaccgggaugauugauggaugguacggcuaccaccaucagaaugaacaagguucuggguaugcggccgaccgcaaguccacacagaacgcaaucgauggcauaacuaauaagguaaacucagugauugagaaaaugaauacccaguucacagcugucggaaaggaguucaaccaccuggaaaaacgaaucgagaauuuaaacaagaaaguggacgacggcuuucuggauguuuggacuuacaacgccgaacuccuugugcuguuggagaaugaaagaacccuagacuaucacgauaguaacgucaagaaucuguacgagaaggugaaaagccagcucaagaacaaugcuaaagagaucgggaacggauguuucgaauuuuaucauaagugcgacgauacauguauggaguccguaaagaaugguaccuacgacuauccaaaguacucugaagaggccaagcugaacagggaagagauugauggcguuaaacuugagagcacucggaucuaccaaauucuggcaauauauucaacgaucgccaguuccuuggugcuccuggucagcuuaggggcuauuucuuucuggaugugcucaaauggaagucugcagugccguaucuguaucuga

SEQ ID NO: 122032 - RNA, 1701 nt, Artificial Sequence; identical to SEQ ID NO: 122030
  derived and/or modified sequence opt3 from hemagglutinin__InfluenzaA__AAF87282

SEQ ID NO: 122033 - RNA, 1701 nt, Artificial Sequence
  derived and/or modified sequence opt3 from hemagglutinin__InfluenzaA__AAF87283
augaaggccauccuggugguccuccuuuacgcuuucaccacagcaaacgccgacacucugugcauuggcuaucacgcgaauaacagcacggauaccguugacacaguguuggagaaaaauguaacugugacccauuccgucaacuuacuggaagauagacacaaugggaagcuauguaaacucaagggaguggcuccccugcaucuugguaaaugcaacauagccggcuggcuguuggggaauccugagugugaacuccuguuuacagcaucuucauggaguuacaucguugagaccagcaacuccgacaauggaacuugcuauccaggcgauuucauuaacuacgaagaacugagggagcagcucucuucggugagcucauuugaacgguucgagaucuuuccgaaggccaguuccuggcccaaucacgaaacaaaccgcggugucaccucugcuuguccuuauagcggggcaaauuccuucuaccgaaacuuaauuuggcuggugaagaaaggaaauucauauccaaaacuuaguaaaagcuacaucaacaacaagggcaaagagguauugguucuguggggcauacaucaucccccuacgucuacugaccaacagucccuauaccagaaugccgaugcuuauguguuugucgggucaagcaaguacaacaagaaauucaugccagagaucgccacccgucccaaggugagaggacaggcggguaggaugaauuauuacuggacacucauugaaccuggcgacacuaucaccuuugaggcaacagggaaccugguggccccacgguaugcuuucgccauggaacgcggaaguggcucugguauuaucauauccgauaccccggucuacgacugcaauacggcaugucaaacucccaaaggggcuauuaacacaagccuuccuuuucagaauauccacccaguuaccauuggagagugccccaaguaugugaaaucgacuaagcugagaauggccacaggcuugaggaacaucccuucuauccagucccggggccucuucggggcgauugccggauuuauagaagguggcuggaccgggaugaucgauggaugguacggcuaccaccaccagaaugagcaagguucaggguaugcaccagaccgcaaaaguacgcagaacgcuauugauggcaucaccaauaagguaaacagcgugauagagaagaugaauacacaguucacugccgucggaaaagaguucaaccaucuggagaagcgaauugaaaauuuaaacaaaaagguggacgacggcuuucugaacguuuggaccuacaaugcugagcuccuugugcuguuggaaaacgagagaacacuagauuaucacgacuccaaugucaaaaaccuguacgagaaggugaggucucagcucaagaauaacgccaaagaaaucgggaauggauguuucgaguuuuaucacaagugcgaugacacuuguauggaaagcguaaagaacgguaccuacgauuaucccaaguacucagaggaagcacggcugaaucgugaggagaucgacggcguuaaacuugaaaguacacgcauuuaccaaauccuggccauuuauuccaccauagcuagcucuuuggugcuccuggucucauuaggggcgaucaguuucuggaugugcagcaacggaucccugcagugcagaauuuguaucuga

SEQ ID NO: 122034 - RNA, 1701 nt, Artificial Sequence
  derived and/or modified sequence opt3 from hemagglutinin__InfluenzaA__AAF87284
augaaggccauccuggugguccuccuuuacgcuuucaccacagcaaacgccgacacucugugcauuggcuaucacgcgaauaacagcacggauaccguugacacaguguuggagaaaaauguaacugugacccauuccgucaacuuacuggaagauagacacaaugggaagcuauguaaacucaagggaguggcuccccugcaucuugguaaaugcaacauagccggcuggcuguuggggaauccugagugugaacuccuguuuacagcaucuucauggaguuacaucguugagaccagcaacuccgacaauggaacuugcuauccaggcgauuucauuaacuacgaagaacugagggagcagcucucuucggugagcucauuugaacgguucgagaucuuuccgaaggccaguuccuggcccaaucacgaaacaaaccgcggugucaccucugcuuguuuacuguucuggagcaagcaacuuuugcagaaacugaauauggcagggaagaaaggaaacuccuauccuaagcuaucaaaaaguuacauuaauaacaagggcaaggaggugcucguacuguggggcauccaucacccacccacgagcacugaccagcagucucuuuaucaaaacgccgaugcuuacguuuuugugggguccucaaaauacaauaagaaauucaugccugagauagccacccgaccaaagguccguggacaggcggguagaaugaacuauuacuggacacugaucgaacccggcgacacuauuaccuuugaggcaacagggaauuugguggccccuagguaugcuuucgccauggaacggggaagcggcagugguaucauuaucucugauaccccaguguacgacugcaacacggcaugucagacuccgaaaggggcuauaaauacaucccuccccuuucagaacauucacccugucaccaucggagagugcccaaaguauguuaaaagcacuaagcugcgcauggccacaggcuuaagaaauauucccucgauccaaucuaggggccuguucggggcgaucgccggauuuauugaagguggcuggaccgggaugauagauggaugguacggcuaucaucaccagaacgagcaggguuccggguacgcagcugaccggaagucaacgcagaaugccaucgauggcauuaccaacaaagugaauaguguaaucgagaagaugaacacacaauucacugcugugggaaaagaguucaaucaucucgagaagcgcauagaaaaccuuaauaaaaaggucgacgacggcuuucugaacguguggaccuacaacgccgaguugcuaguucugcucgaaaaugagcgaacacuggauuaucacgacagcaacgugaagaaucuuuacgagaaagucagaucccagcugaagaacaaugcaaaagaaauugggaacggauguuucgaguuuuaucacaagugcgaugacacuuguauggaaucugugaaaaaugguaccuacgauuauccuaaguacagcgaggaagccagguugaaccgggaggagaucgacggcguaaagcucgaaucaacacguaucuaucagauucuggcuaucuacaguaccauugcguccagcuuaguucugcuagugucucucggggcaauaucauucuggaugugcaguaauggaagccugcaaugccgcaucuguauuuga

SEQ ID NO: 122035 - RNA, 1701 nt, Artificial Sequence
  derived and/or modified sequence opt3 from hemagglutinin__InfluenzaA__AAG01749
augagcaccaucauugcccuguccuacauacucugccuuguguucgcucagaagcugcccggcaacgacaauucuacagcaacuuuguguuuagggcaccaugccgucccuaacggaacgcugguuaaaaccaucacaaaugaucaaauugaggugacuaacgcgaccgaacuuguacagucaaguagcacagguagaaucugcgacuccccacacaggauucucgauggcaagaauuguacccugaucgacgcucuacugggggauccgcauugcgacggauuucagaacaaagagugggauuuguucguggaacggucuaaggccuauucgaauuguuaccccuaugacgucccugauuacgcaucacuccgcagccugguggccaguuccggcacucuggaguuuacaaacgaagguuucaauuggaccgggguugcucaggacggaacgucuuaugcaugcaaacgaggcagcgugaaguccuuuuucucacgucucaacugguuacacaagcuggaguacaaauauccagcccuuaaugucacuaugcccaacaaugauaaguuugacaaauuguacauauggggcgugcaucacccuaguaccgauagcgaccaaacaucucuguacguacaggcuuccgggagaguuacugugucaaccaagaggagccagcagacagucaucccaaacauuggaagucggcccugggugcgcgguaucucuuccagaauuagcaucuauuggaccauagugaaaccuggcgacauucuacucaucaauucgacggggaaccugauugccccaaggggauacuucaagauccggucuggcaaguccucaaucaugcgcagugaugcgccgauugacaacuguaauagcgagugcauaacucccaacgguuccaucccuaaugaaaaaccauuucaaaacgucaaucgaauuacauauggggcaugucccagauacguuaagcagaacacccuuaaacuggccacuggaaugaggaaugugccugagaagcagacacggggcaucuucggcgcuauagccggguuuauugaaaacggaugggaggguaugguagauggcugguauggguuccgucaccaaaauucugagggaaccggccaggcagcugacuugaaaagcacgcaggccgcgaucaaccagaucaaugguaagcucaaccgccugauugagaaaaccaaugaaaaguuucaucaaaucgaaaaggaguucucagaaguggaggggaggauucaggauuuagagaaauacgucgaagacacaaagauagaucuguggaguuauaacgccgagcuccuuguggcacuggaaaaucagcacacuaucgacuugaccgauuccgagaugaacaaacuauucgaaagaacacggaagcagcugcgagagaacgcugaggacaugggcaauggaugcuuuaaaauuuaccauaagugugauaacgccugcaucggcagcauccgcaaugggacuuacgaccacgacguuuauagagaugaagcucucaacaauagguuccaaauuaagggaguggagcugaaaucugguuacaaggacuggauacuuuggaucucauuugccauuaguugcuuccuguugugugucgugcuccugggcuuuaucaugugggcaugccagaaagggaacauucgguguaauaucugcauauga

SEQ ID NO: 122036 - RNA, 1701 nt, Artificial Sequence
  derived and/or modified sequence opt3 from hemagglutinin__InfluenzaA__AAG01767
augaacaccaucauugcccugagcuacauacucugccuuguguucgcucagaagcugcccggcaaugacaacuccacagcaacuuuguguuuagggcaccaugccgucccuaauggaacgcugguuaaaaccaucacaaacgaucaaauugaggugacuaaugcgaccgaacuuguacagucuucaaguacagguagaaucugcgacagcccacacaggauucucgauggcaagaacuguacccugaucgacgcucuacugggggauccgcauugcgacggauuucagaauaaagagugggauuuguucauagaacgguccaaggccuauucuaacuguuaccccuaugacgugccugauuacucgucacuccgcagccuggucgcaaguuccggcacucuggaguuuacaaaugaagacuucaacuggaccgguguggcccaggaugggggaucuuauagcugcaaacgagaguccguuaagucauuuuucagucgucucaauugguuacacaagcuggaguacaaauauccagcucuuaacgugacgaugcccaauaacgacaaguuugauaaauuguacaucuggggcguccaucacccuagcacugacucugaacaaaccucccuguacgugcaggcaauuggcagaguaacaguuucaacuaagagcagucagcagaccgugaucccaaauauugggucuaggcccuggguccggggaaucuccagccgcauaucgauuuauuggacaaucgugaaaccuggugacauucuacucaucucuuccaccggcaaccugaucgccccaagaggguacuucaagauuaggaacggaaagucaaguauaaugcggagcgaugcuccgaucgacaauuguuauuccgagugcauuacgcccaacggcucuaucccuaaugauaaaccauuucaaaacgugaaucgcauaacuuacggugccugucccaaguaugucaaacagaagacacuuaaacuggcgaccgggaugcgaaacguuccugaaaagcagacuagaggaauuuucggcgcaaucgccggcuuuaucgagaaugggugggagggaaugguggacgguugguacggcuucaggcaccagaacagcgaagggacaggacaagcugccgauuugaaaucaacccaggcagcuauugaccagguaaauggcaagcucaaccggcugaucgagaagacgaaugaaaaauuucaucaaauugagaaggaguucagugaaguggagggucguauacaggauuuagaaaaauaugucgaggacaccaagaucgaucugugguccuacaacgccgaacuccuuguggcgcuggagaaucagcacacaauugacuugacugauagcgaaaugaacaaacuauucgagaagacccgcaagcagcugagagagaaugccgaagacauggggaacggcugcuuuaaaaucuaccauaagugugacaacgcaugcaucggaucuauuaggaauggcacauaugaucacgacguuuaccgggaugaggcucucaacaaucgauuccaaauaaaagggguggaacugaagucaggauauaaagacuggauccuuuggauuaguuuugccaucagcugcuuccuguugugugucgugcuccuggguuuuauuaugugggcuugccagaagggcaacauccgcuguaauauaugcaucuga

SEQ ID NO: 122037 - RNA, 1701 nt, Artificial Sequence
  derived and/or modified sequence opt3 from hemagglutinin__InfluenzaA__AAG01776
augaacaccaucauugcccugagcuacauacucugccuuguguucgcucagaagcugcccggcaaugacaacuccacagcaacuuuguguuuagggcaccaugccgucccuaauggaacgcugguuaaaaccaucacaaacgaucaaauugaggugacuaaugcgaccgaacuuguacagucuucaaguacagguagaaucugcgacagcccacacaggauucucgauggcaagaacuguacccugaucgacgcucuacugggggauccgcauugcgacggauuucagaauaaagagugggauuuguucauagaacgguccaaggccuauucuaacuguuaccccuaugacgugccugauuacucgucacuccgcagccuggucgcaaguuccggcacucuggaguuuacaaaugaagacuucaacuggaccgguguggcccaggaugggggaucuuauagcugcaaacgagaguccguuaagucauuuuucagucgucucaauugguuacacaagcuggaguacaaauauccagcucuuaacgugacgaugcccaauaacgacaaguuugauaaauuguacaucuggggcguccaucacccuagcacugacucugaacaaaccucccuguacgugcaggcaauuggcagaguaacaguuucaacuaagagcagucagcagaccgugaucccaaauauugggucuaggcccuggguccggggaaucuccagccgcauaucgauuuauuggacaaucgugaaaccuggugacauucuacucaucucuuccaccggcaaccugaucgccccaagaggguacuucaagauuaggaacggaaagucaaguauaaugcggagcgaugcuccgaucgacaauuguuauuccgagugcauuacgcccaacggcucuaucccuaaugauaaaccauuucaaaacgugaaucgcauaacuuacggugccugucccaaguaugucaaacagaagacacuuaaacuggcgaccgggaugcgaaacguuccugaaaagcagacuagaggaauuuucggcgcaaucgccggcuuuaucgagaaugggugggagggaaugguggacgguugguacggcuucaggcaccagaacagcgaagggacaggacaagcugccgauuugaaaucaacccaggcagcuauugaccagguaaauggcaagcucaacuggcugaucgagaagacgaaugaaaaauuucaucaaauugagaaggaguucagugaaguggagggucggauacaggauuuagaaaaauaugucgaggacaccaagaucgaucugugguccuacaacgccgaacuccuuguggcgcuggagaaucagcacacaauugacuugacugauagcgaaaugaacaaacuauucgagaagacccguaagcagcugcgcgagaaugccgaagacauggggaacggcugcuuuaaaaucuaccauaagugugacaacgcaugcaucggaucuauuagaaauggcacauaugaucacgacguuuacagggaugaggcucucaacaaucgguuccaaauaaaagggguggaacugaagucaggauauaaagacuggauccuuuggauuaguuuugccaucagcugcuuccuguugugugucgugcuccuggguuuuauuaugugggcuugccagaagggcaacauccgauguaauauaugcaucuga

SEQ ID NO: 122038 - RNA, 1701 nt, Artificial Sequence
  derived and/or modified sequence opt3 from hemagglutinin__InfluenzaA__AAG01785
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucauagaacgguccaaagccuauucuaauuguuaccccuaugacgugccugauuacucgucacuccgcagccuggucgcaaguuccggcacucuggaguuuacaaacgaagacuucaauuggaccgguguggcccaggaugggggaucuuauagcugcaagcgagaguccguuaagucauuuuucagucgucucaacugguuacacaaacuggaguacaaguauccagcucuuaaugugacgaugcccaacaaugacaaauuugauaaguuguacaucuggggcguccaucacccuagcacugacucugaacaaaccucccuguacgugcaggcaauuggcagaguaacaguuucaacuaaaagcagucagcagaccgugaucccaaacauugggucuaggcccuggguccggggaaucuccagccgcauaucgauuuauuggacaaucgugaagccuggugacauucuacucaucucuuccaccggcaaucugaucgccccaagaggguacuucaagauuaggaacggaaaaucaaguauaaugcggagcgaugcuccgaucgacaacuguuauuccgagugcauuacgcccaauggcucuaucccuaacgauaagccauuucaaaaugugaaccgcauaacuuacggugccugucccaaauaugucaagcagaaaacacuuaagcuggcgaccgggaugcgaaauguuccugaaaaacagacuagaggaauuuucggcgcaaucgccggcuuuaucgagaacgggugggagggaaugguggacgguugguacggcuucaggcaccagaauagcgaagggacaggacaagcugccgauuugaagucaacccaggcagcuauugaccagguaaacggcaagcucaaucggcugaucgagaaaacgaacgaaaaguuucaucaaauugagaaagaguucagugaaguggagggucguauacaggauuuagaaaaguaugucgaggacaccaaaaucgaucugugguccuacaaugccgaacuccuuguggcgcuggagaaccagcacacaauugacuugacugauagcgaaaugaauaagcuauucgagaagacccgcaaacagcugagagagaacgccgaagacauggggaauggcugcuuuaagaucuaccauaaaugugacaacgcaugcaucggaucuauuaggaacggcacauaugaucacgacguuuaccgggaugaggcucucaauaaccgauuccaaauaaaggggguggaacugaaaucaggauauaaggacuggauccuuuggauuaguuuugccaucagcugcuuccuguugugugucgugcuccuggguuuuauuaugugggcuugccagaagggcaauauccgcuguaacauaugcaucuga

SEQ ID NO: 122039 - RNA, 1701 nt, Artificial Sequence
  derived and/or modified sequence opt3 from hemagglutinin__InfluenzaA__AAK52911
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacaccagauucucgauggcaaaaauuguacccugaucgacgcccuucugggggauccgcauugcgacggauuucagaacaaggagugggauuuguucguggaaagguccacugcuuauucuaauuguuaccccuaugacgucccugauuacgcaucgcuccggucacugguggccagcaguggcacacuggaguuuaccaaagaagguuucaacuggacggggguugcucaagacggaacuuccuaugcaugcaagcgcggcucugucaagagcuuuuucucccgacucaauugguuacacaaacuggaguacaaguauccagcccuuaacgugaccaugcccaauaacgauaaauuugacaaguuguacauauggggcgugcaucacccuucaacagauagugaccagacuagccuguacguacaggcuucugggcguguuaccguguccacaaaaagaucacagcaaaccgucaucccaaauauuggaagcaggcccugggugcggggugugaguucucgcaucuccauuuauuggacgaucgucaagccuggcgacauacuacucauuaacagcacugggaaucugaucgccccaagaggauacuucaagauuaggucgggcaaaucuuccaucaugcggucagaugcgccgaucgacaacuguaacagugagugcauuacacccaaugguagcauaccuaacgauaagccauuucagaauguuaaccgcaucaccuauggggcauguccccgauacgugaaacagaauacucuuaagcuggccacaggaaugagaaacguaccugaaaaacagaccaggggcauuuucggcgcuaucgccggguuuauagagaauggaugggaagguaugguggacggcugguauggguuccggcaccaaaacuccgagggaacgggccaggcagcugauuugaagucuacccaggccgcgauuaaucaaaucaacgguaaacucaaucgucugaucgagaagacaaacgaaaaguuucaucagauugagaaagaguucagcgaagucgaagggcgcauccaggacuuagagaaguacguggaggauacuaaaauugaccuguggucauauaaugccgaacuccuuguugcacuggagaaccagcacaccauagauuugacagacagugaaaugaauaagcuauucgagagaacuaggaaacaacugcgggaaaacgcugaggauaugggcaacggaugcuuuaagaucuaccauaagugugacaaugccugcauuggcuccauccgaaacgggaccuacgaccacgauguguaucgcgacgaggcucucaauaacagauuccagaucaaaggagucgaacuaaagagcgguuacaaagauuggauucuuuggauaucuuuugccaucucaugcuuccuguugugugugguacuccugggcuuuauuaugugggcaugccagaaggggaauaucagguguaacauuugcaucuga

SEQ ID NO: 122040 - RNA, 1701 nt, Artificial Sequence
  derived and/or modified sequence opt3 from hemagglutinin__InfluenzaA__AAK52912
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacggacuaaagccuauuccaauuguuaccccuaugacgucccugauuacgcaucucuccgcucgcugguggccucaagcggcacacuggaguuuaccaacgaagguuucaauuggacggggguugcucagaacggaacuagcuaugcaugcaagcgaggcuccgugaagucuuucuucagccgucucaauugguuacacaaacuggaguacaaguauccagcccuuaacgucaccaugcccaauaacgacaaauuugauaaguuguacauauggggcgugcaucacccuuccacagacucagaucaaaccagucuguacguacaggcuagcgggagaguuacugugucuacaaaaaggucccagcagaccgucaucccaaauauuggaucacggcccugggugcgcggugugagcaguagaaucucuauuuauuggacgaucgucaagccuggcgacauacuacucauuaacuccacugggaaccugaucgccccaaggggauacuucaagauucggagcggcaaaucgucuaucaugcgcuccgacgcgccgaucgguaauuguaacucagagugcauuacacccaaugggaguauaccuaacgauaagccauuucaaaauguuaaccgaaucaccuauggagcaugucccagauacgugaaacagaauacucuuaagcuggccacaggcaugaggaacguaccugaaaaacagacccggggcauuuucggggcuaucgccggauuuauagagaaugguugggaaggcaugguggacgggugguauggauuccgucaccagaacagcgagggcacgggucaagcagcugauuugaaguccacccaggccgcgauuaaucagaucaacgggaaacucaaucgccugaucgagaagacaaacgaaaaguuucaucaaauugagaaagaauuuucugaggucgaaggcagaauccaggacuuagagaaguacguggaggauacuaaaauugaccuguggagcuauaaugccgaacuccuuguugcacuggagaaccagcacaccauagauuugacagacucagaaaugaacaagcuauucgagaggacucggaaacagcugcgagaaaaugcugaggauaugggaaacggcugcuuuaagaucuaccauaagugugacaaugccugcauugggaguauccgcaacggaaccuacgaucacgacguguauagagacgaggcucucaauaacagguuccaaaucaaaggugucgaacugaaguccggcuacaaagauuggauucuuuggauaaguuuugccaucucuugcuuccuguugugugugguacuccugggguuuauuaugugggcaugccagaagggaaauauccgguguaacauuugcaucuga

SEQ ID NO: 122041 - RNA, 1701 nt, Artificial Sequence
  derived and/or modified sequence opt3 from hemagglutinin__InfluenzaA__AAK71687
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauagacacaaugggaagcuauguaaacucaggggaguggcgccccugcaucuugguaagugcaacauagcuggcuggcuguuggggaauccugagugugaaucucucuuuaccgccucaaguuggagcuacaucguugagacuuccaacucugacaauggaacaugcuauccaggcgauuucauuaacuacgaagaacugcgggagcagcugucgucagugagcaguuuugaacgcuucgagaucuuuccggaaaccuccucuuggcccaaucacgacacgaaccgaggugucacugcagccuguccucaugcuggggcaaauagcuucuaucguaaccucauuugguuagccaaaaagggagauuccuacccaaagcugucaaaaaguuauaucaauaacaagggcaaagaggugcuuguauuguggggcauacaccaucccccuaccagcgcugaccaacagucucuguaccagaacgccgaugcguacguuuuugugggguccucaagauauagcaagaaauucaagccagagaucgcaacaaggcccaagguccggggacaggccggucgcaugaauuacuauuggacucuaguggaaccuggcgacaaaauuaccuuugaggcuacagggaaccucguggucccaagauacgccuucgcaaugaagaggaauagugaaucuggaaucauuaucuccgauauaagcguucacgacugcaacaccacgugucaaacuccgaaaggcgcuauuaauacaucgcugcccuuucagaacauccacccugugaccauuggugagugcccaaaguauguaaaaucuacuaaacuucggauggccacagggcugcgcaaugugcccuccauccagucacgaggauuguucggcgcgaucgccggcuuuauugaagggggauggaccgguaugauagauggcugguacggguaucaucaccagaacgagcaaggaaguggcuacgcagcugaccucaaaagcacgcagaaugccaucgacgguauuaccaacaaggucaauuccgugaucgagaagaugaacacacaguucacuguuguggggaaagaguucaaucaccuggagaagagaauagaaaacuuaaauaaaaaggucgaugacggcuuucuggauauuuggaccuacaacgcugagcuccuugugcuguuggaaaacgagaggacacuagacuaucaugauucuaauguaaagaaccuguacgagaagguucggagccagcucaagaauaacgccaaagaaaucggaaauggcuguuucgaguuuuaucacaagugcgacgauacuuguauggaaucagugaaaaacgggaccuacgacuauccuaaguacagugaggaagcaaaacugaaucgugaggagaucgauggagucaaacuugaauccacacgcauuuaucaaauccuggccauuuacagcaccguggcuucuucauugguccucgugguuagucuggguacuaucagcuucuggaugugcuccaacggcucuuuacagugcagaauauguauuuga

SEQ ID NO: 122042 - RNA, 1707 nt, Artificial Sequence
  derived and/or modified sequence opt3 from hemagglutinin__InfluenzaA__AAS65618
auggagaagaucgugcuucucuucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagugagccugggaguaaguuccgcuuguccauaccagggcaaaucuagcuucuuucggaacguuguguggcugaucaagaaaaauuccacauaucccacuauaaagcgcucauacaacaauaccaaccaagaggaccucuuaguccugugggguauucaccacccuaaugaugccgcagagcagacaaagcuguaucagaacccaaccacuuacaucaguguggggacaagcaccuugaaccagcgacuggugccccguauugccacgagaucuaaagucaauggacaauccggcaggauggaguucuuuuggacuauccuaaagccuaacgacgcuaucaauuucgaaucaaacggcaauuuuauugcaccagaauacgccuauaaaauaguuaagaaaggggauagcaccaucaugaagagugagcucgaauacggaaacugcaauacaaaaugucagacuccgaugggugcuauuaacucuuccaugcccuuccauaauauccacccucugaccauaggcgagugcccaaaguaugugaaaagcaaccggcuuguacuggccacaggguugcgcaauucgccccagagagagaggcggcgcaaaaagcgaggacucuuuggcgcgauugcagguuucaucgaagggggauggcagggcaugguggacggcugguacggguaucaucacucuaacgagcaaggauccgguuacgccgcugccaaagaaucaacccagaaggcaaucgacggcgucacgaauaaagugaacaguauuaucgauaagaugaauacucaguuugaggcuguugggagagaguucaacaaccuggaaaggcggauugagaauuuaaacaagaaaauggaagacggauuccuggauguguggacauauaaugccgagcuccuuguccugauggaaaacgagcguaccuuggacuuucacgauagcaaugugaagaaccuauacgacaaaguacgccugcaacucaaggauaaugcgaaagaacugggcaacgguuguuucgaguuuuaccauaagugcgacaaugaguguauggaauccguuagaaacgggacuuaugauuacccucaguauucugaggaagccaggcuuaagcgggaggagauaagcggcgugaaacuggaaucaaucggaauuuaccagaucuugaguaucuauuccacagucgcaagcucucucgcucuggccauuaugguggcuggcuuaucacuguggaugugcaguaaugggagccuacagugccgaauauguaucuga

SEQ ID NO: 122043 - RNA, 1704 nt, Artificial Sequence
  derived and/or modified sequence opt3 from hemagglutinin__InfluenzaA__AAT38819
augaacacccagauccuggccuucauugcuugcaugcucauaggcacaaagggggacaaaaucugucuuggacaccaugcaguggccaaugguacuaaggucaacacgcugaccgagagaggcauugaaguugugaaugcgacagagacuguagaaaccgugaacaucaaaaagauuugcacacaagggaaaaggcccaccgauuugggacaguguggcuuacuggguacucuaaucgggccuccacagugcgaccaguuucucgaguucgaugcuaaucugauaaucgaacggcgcgagggaacagacgucuguuacccgggcaaguuuaccaacgaggaaagccuucgacaaauucugcguggcuccgggggaaucgauaaggagucuauggguuucacguauucaggcauuagaacuaauggggccaccagugcaugcaggcggagcggauccucuuuuuacgccgaaaugaaaugguugcucucgaacucagacaaugcugcauucccccagaugacaaagagcuaucgcaacccuagaaauaaaccagcccugaucauauggggcgugcaccauagugguuccgcuacugagcagaccaagcuguacgggucuggaaacaaacucauuacaguuggcagcuccaaguaucagcaaucauuuacccccaguccuggcgccaggccacaggugaaugggcagagcggacggaucgauuuccacugguuacugcuugaccccaacgauacggucacuuuuacauucaauggugcguuuauugcaccugaccgcgccucuuucuuucgaggcgaguccuugggggugcagucagauguaccacuggacagcggaugugaaggcgauugcuuccauaguggugggaccaucguuucuucccuaccguuccaaaacaucaaccccagaacugugggcaaguguccuagguacgucaaacagacaagccuccugcuugcuaccggaaugcggaaugugccagagaaccccaagcaggccuaucaaaaacagaugacgcguggccuguuuggggcaauugcuggauucauagaaaaugguugggagggcuugaucgacgggugguacggauuucgccaccagaacgcccagggcgaagguaccgcggccgacuacaagucgacacaaucugcaauugaucagaucacugggaaacucaauagacugauagacaagaccaaccagcaguucgaguuaauugauaaugaguuuuccgaaaucgagcaacagaucggcaacgugauuaauuggacaagggacucaaugacugaagucuggaguuauaacgcugagcugcucguugccauggaaaaucagcacaccaucgaucuugcugacagcgagaugaacaaacuguacgagcgggugcgaaagcaguugcgcgaaaaugccgaggaagauggaacaggcugcuucgagauuuuucauaagugugacgaucaaugcauggaauccauaagaaacaauaccuaugaccacacucaguacaggacggagucucuacagaaccggauccagauugauccuguaaaacugagcucaggguauaaggacaucauccucugguucaguuuuggagcauccugcuuccugcuucuggccauugcuauggguuugguguuuauauguaucaaaaacggcaauaugcgcugcacaauuuguaucuga

SEQ ID NO: 122044 - RNA, 1707 nt, Artificial Sequence
  derived and/or modified sequence opt3 from hemagglutinin__InfluenzaA__AAV32636
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaggcggcgcaaaaagcgaggacucuuuggcgcaauugccgguuucaucgaagggggauggcagggcaugguagacggcugguacggguaucaucacucuaacgagcaaggauccgguuacgcugccgacaaagaaucaacccagaaggcaaucgauggcgugacgaauaaagucaacaguauuaucgacaagaugaauacucaguuugaggcuguggggagagaguucaacaaccuggaaaggcggauugagaauuuaaacaagaaaauggaagauggauuccuggacguuuggacauauaaugccgagcuccuugugcugauggaaaacgagcguaccuuggauuuucacgacagcaaugucaagaaccuauacgauaaagugcgccugcaacucagagacaaugcgaaggaacugggcaacgguuguuucgaguuuuaccauaaaugcgauaaugaguguauggaauccguaaggaacgggacuuaugacuacccucaguauucugaggaagcccggcuuaagcgagaggagauaagcggcguuaagcuggaaucaaucggaauuuaccagaucuugaguaucuauuccacaguggcaagcucucucgcucuggccauuauggucgcuggcuuaucacuguggaugugcaguaaugggagccuacagugccgcauauguaucuga

SEQ ID NO: 122045 - RNA, 1707 nt, Artificial Sequence; identical to SEQ ID NO: 122044
  derived and/or modified sequence opt3 from hemagglutinin__InfluenzaA__AAV34704

SEQ ID NO: 122046 - RNA, 1707 nt, Artificial Sequence
  derived and/or modified sequence opt3 from hemagglutinin__InfluenzaA__AAV65826
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugggugggauucaccacccuaaugaugcagccgagcagacaaaacuuuaucagaacccaaccacuuacaucagugucggaacaagcaccuugaaccagcgacuggugccccguauugcuacgagaucuaaagugaauggccaauccggcaggauggaguucuuuuggacuauccuaaagccuaacgacgcaaucaauuucgaaucaaacgggaauuuuauugccccagaauacgcuuauaaaauagucaagaaaggagauagcaccaucaugaagagugagcucgaauacgguaacugcaauacaaaaugucagacuccgaugggcgccauuaacucuuccaugcccuuccauaauauccacccucugaccauaggggagugcccaaaguauguuaagagcaaccggcuugugcuggcgacaggauugcgcaauucgccccagagagagaggcggcgcaaaaagcgaggccucuuuggugcaauugccggguucaucgaaggaggcuggcagggcaugguagacgggugguacggauaucaucacucuaacgagcaagguuccggcuacgcugccgacaaagaaucaacccagaaggcaaucgauggggugacgaauaaagucaacaguauuaucgacaagaugaauacucaguuugaggcugugggaagagaguucaacaaccuggaaaggcggauugagaauuuaaacaagaaaauggaagauggcuuccuggacguuuggacauauaaugccgagcuccuugugcugauggaaaacgagcguaccuuggauuuucacgacagcaaugucaagaaccuauacgauaaagugcgccugcaacucagagacaaugcgaaggaacuggguaacggguguuucgaguuuuaccauaaaugcgauaaugaguguauggaauccguaaggaacggcacuuaugacuacccucaguauucugaggaagcccggcuuaagcgagaggagauaagcggaguuaagcuggaaucaaucggcauuuaccagaucuugaguaucuauuccacaguggcaagcucucucgcucuggccauuauggucgcuggguuaucacuguggaugugcaguaauggaagccuacagugccgcauauguaucuga

SEQ ID NO: 122047 - RNA, 1701 nt, Artificial Sequence
  derived and/or modified sequence opt3 from hemagglutinin__InfluenzaA__AAX11505
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcgagcggcgcuccaacaagucauuuuucagucgacugaauuggcucacucauuuaaaguauaaauacccagcacugaacgugaccaugcccaauaacgagaaguuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccaucgucaaaccuggugacauucugcuaaucaauucgacgggcaaccucaucgccccaaggggguauuucaagauucggucuggaaaguccucaauaaugcgcagugacgcgccgaucggcaaauguaauagcgaaugcauuacucccaacgguuccaucccuaaugauaagccauuucagaacgugaaucgaauaacauacggggcaugucccagauaugugaaacagaacacccugaaacuugccacuggaaugaggaaugucccugagaaacaaacacggggcauuuucggcgcuaucgccggguuuaucgaaaacggaugggaggguaugguugacggcugguacggguuccgucaccagaauagcgagggaaccggccaggcagcugaucugaagucuacgcaagccgcgauuaaccagaucaaugguaaauugaaccgccucauugggaagaccaaugaaaaguuucaccagauagagaaagaguucucagaaguggaaggcagaauccaggaccuggagaaguauguagaggauacaaaaauugacuuauggaguuacaacgccgaacugcucguggcacuugagaaccaacauacuaucgaucugaccgacuccgaaaugaauaaguuguucgagaggacaaagaagcagcuacgggaaaacgcugaggauaugggaaauggcugcuuuaagaucuaucacaaaugugacaacgccugcauugggagcauacgaaauggaacuuacgaucaugacgucuaccgcgacgaggcucugaacaauagauuccagaucaaggguguggaacucaaaucuggcuauaaggauuggauucuguggaucucauuugccauuaguugcuuccuucuguguguugcauugcucggguuuaucaugugggccugccagaaaggaaacauaaggugugacaucugcauuuga

SEQ ID NO: 122048 - RNA, 1701 nt, Artificial Sequence
  derived and/or modified sequence opt3 from hemagglutinin__InfluenzaA__AAX11525
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucaccagauagaaaaggaguucucagaaguggagggcagaauccaggaucuggaaaaauauguagaggacacaaagauugauuuauggaguuacaaugccgagcugcucguggcacuugaaaaccaacauacuaucgaccugaccgauuccgagaugaacaaauuguucgaaaggacaaagaagcagcuacgggagaaugcugaagacaugggaaacggcugcuuuaaaaucuaucacaagugugauaaugccugcauugggagcauacgaaacggaacuuacgaccaugacgucuaccgcgaugaggcucugaauaacagauuccagaucaaagguguggagcucaagucuggcuauaaagacuggauucuguggaucucauuugccauuaguugcuuccuucuguguguugcauugcucggguuuaucaugugggccugccagaagggaaauauaagguguaacaucugcauuuga

SEQ ID NO: 122049 - RNA, 1701 nt, Artificial Sequence; identical to SEQ ID NO: 122048
  derived and/or modified sequence opt3 from hemagglutinin__InfluenzaA__AAX11535

SEQ ID NO: 122050 - RNA, 1701 nt, Artificial Sequence; identical to SEQ ID NO: 122048
  derived and/or modified sequence opt3 from hemagglutinin__InfluenzaA__AAX11545

SEQ ID NO: 122051 - RNA, 1701 nt, Artificial Sequence; identical to SEQ ID NO: 122047
  derived and/or modified sequence opt3 from hemagglutinin__InfluenzaA__AAX11555

SEQ ID NO: 122052 - RNA, 1701 nt, Artificial Sequence; identical to SEQ ID NO: 122048
  derived and/or modified sequence opt3 from hemagglutinin__InfluenzaA__AAX11565

SEQ ID NO: 122053 - RNA, 1701 nt, Artificial Sequence
  derived and/or modified sequence opt3 from hemagglutinin__InfluenzaA__AAX11585
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacaacgaucagaucaguuuguacgcccaggcuagcgggcguauuacugugucuaccaagagaucccaacagacaguaaucccaaacauaggaucaaggccccggguucgcgacgugagcagucagauuucuaucuacuggaccauugucaagccuggugacauccugcuaaucaauuccacgggcaaccucauugccccaagaggguauuucaagauaaggagcggaaaaucgucuaucaugcgguccgaugcgccgauuggcaaguguaauucagagugcaucacucccaacgguaguauaccuaaugacaaaccauuucagaacgugaaucgcauuacauacggggcauguccccgauaugugaagcaaaacacccugaaacuugccacuggaaugagaaaugucccugaaaagcagacaaggggcaucuucggcgcuaucgccggguuuauugagaacggaugggaagguaugguugauggcugguacggguuccggcaccagaauagcgagggaaccggccaagcagcugaccugaaauccacgcaggccgcgaucaaccagauuaaugguaaguugaaccgucucauagggaagaccaaugagaaauuucaccagaucgaaaaggaguucucugaaguggagggccgcauucaagaucuggaaaaauauguagaggacacaaagaucgauuuauggagcuacaacgccgagcugcucguggcacuugaaaaccagcauacuaucgaccugaccgauucagagaugaauaaauuguucgaaagaacaaagaagcagcuaagggagaacgcugaagacaugggaaauggcugcuuuaaaauuuaucacaagugugauaacgccugcauagggaguauccggaauggaacuuacgaccaugacgucuaccgagaugaggcucugaacaaucgcuuccagauuaaagguguggagcucaaguccggcuauaaagacuggauccuguggauuagcuuugccaucucuugcuuccuucuguguguugcauugcucggguuuauaaugugggccugccaaaagggaaacaucagauguaauauuugcaucuga

SEQ ID NO: 122054 - RNA, 1701 nt, Artificial Sequence; identical to SEQ ID NO: 122048
  derived and/or modified sequence opt3 from hemagglutinin__InfluenzaA__AAX11605

SEQ ID NO: 122055 - RNA, 1701 nt, Artificial Sequence; identical to SEQ ID NO: 122048
  derived and/or modified sequence opt3 from hemagglutinin__InfluenzaA__AAX11615

SEQ ID NO: 122056 - RNA, 1701 nt, Artificial Sequence
  derived and/or modified sequence opt3 from hemagglutinin__InfluenzaA__AAX11625
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucugggcccuggguccggggaguguccagccgcauuucgaucuacuggaccauagugaaaccuggugacauucuacucaucaacucuacaggcaaucugauugccccaagaggguauuucaagaucagguccggaaagucaaguaucaugcggagcgacgcgccgauuggcaaauguaacuccgaaugcauaacccccaaugguucuaucccuaacgauaagccauuucagaaugucaaccgcauuacguacggggcauguccccgauauguuaaacagaauacucuuaagcuggccacaggaaugagaaacgugccugagaaacaagcuaggggcaucuucggcgccauagcaggguuuauugaaaauggaugggaggguaugauggacggcugguacggguuccggcaccagaacagcgagggaaccggccaggcugccgauuugaagucaacucaagcggccaucaaucagaucaacgguaaacucaaucgucugauugaaaagacaaacgagaaguuucaucagaucgaaaaagaguucagugaaguagaggggcgcauucaggacuuagagaaguauguggaagauaccaaaauagaccugugguccuacaaugcagagcuccuugucgcucuggaaaaccaacacacgaucgauuugaccgacagcgagaugaacaagcuauucgaaagaacuaaaaagcagcugagggagaaugccgaggauaugggcaacggaugcuuuaagauuuaucauaaaugugacaaugcuugcaucggcucuauccggaacgggacauacgaucacgacguguaccgagacgaagcccucaauaaccgcuuccagauuaagggaguugagcugaaaucagguuauaaggauuggauacuuuggaucaguuuugcaauuagcugcuuccuguuguguaucgugcuccugggcuuuauuaugugggccugccagaaagggaauaucagauguaacauaugcaucuga

SEQ ID NO: 122057 - RNA, 1701 nt, Artificial Sequence; identical to SEQ ID NO: 122048
  derived and/or modified sequence opt3 from hemagglutinin__InfluenzaA__AAX12731

SEQ ID NO: 122058 - RNA, 1701 nt, Artificial Sequence
  derived and/or modified sequence opt3 from hemagglutinin__InfluenzaA__AAX12741
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucaccagauagaaaaggaguucucagaaguggagggcagaauccaggaucuggaaaaauauguagaggacacaaagauugauuuauggaguuacaaugccgagcugcucguggcacuugaaaaccaacauacuaucgaccugaccgauuccgagaugaacaaauuguucgaaaggacaaagaagcagcuacgggagaaugcugaagacaugggaaacggcugcuuuaaaaucuaucacaagugugauaaugccugcauugggagcauacgaaacggaacuuacgaccaugacgucuaccgcgaugaggcucugaauaacagauuccagaucaaagguguggagcucaagucuggcuauaaagacuggauucuguggaucucauuugccaccaguugcuuccuucuguguguugcauugcucggguuuauuaugugggccugccagaagggaaauaucagguguaacauaugcaucuga

SEQ ID NO: 122059 - RNA, 1701 nt, Artificial Sequence; identical to SEQ ID NO: 122048
  derived and/or modified sequence opt3 from hemagglutinin__InfluenzaA__AAX12751

SEQ ID NO: 122060 - RNA, 1701 nt, Artificial Sequence
  derived and/or modified sequence opt3 from hemagglutinin__InfluenzaA__AAX12761
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugcggagcuccuugucgcccuggaaaaccaacacaccaucgauuugacagacuccgagaugaacaagcuauucgaaagaacuaaaaagcagcugcgggagaaugcagaggauaugggcaacggaugcuuuaagauuuaucauaaaugugacaaugugugcaucggcagcauccgaaacgggaccuacgaucacgacguuuaccgcgacgaagcucucaauaacagauuccagauuaagggaguggagcugaaaucugguuauaaggauuggauacuuuggaucucauuugccauuaguugcuuccuguuguguaucguccuccugggcuuuauuaugugggcuugccagaaagggaauaucagguguaacauaugcaucuga

SEQ ID NO: 122061 - RNA, 1701 nt, Artificial Sequence
  derived and/or modified sequence opt3 from hemagglutinin__InfluenzaA__AAX12791
augaagaccaucauugcccugagcuacauacucugccuuguguucgcucagaaacugcccggcaacgacaauuccauggcaacauuguguuuagggcaccaugccgucccuaacggaacucugguuaagacgaucaccaaugaucaaauugaggugacaaacgcgacugaacuuguacagucuucaaguaccgguagaaucugcgacagcccacaccagauucucgauggcgagaauuguacacugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacccuggaauuuaacaaugaguccuucaacuggacugguguggcccaaaaugggacaucuagcgcuugcaaacgccgauccgacaagucauuuuucagucgucucaacugguuacaccagcugaaguauaaauacccagcacuuaaugucaccaugcccaacaaugagaaguuugauaaauuguauauauggggagugcaucacccuggcacggacagcgaucagaucucucuguacgcccaggcuuccggcagaguaacuguuucaaccaagaggagccaacagacagugauuccaaacaucgggaguggacccuggguccggggugugucuucccgcauuagcaucuacuggacuauagugaaaccuggcgacauucuacucaucaacucgaccgggaaucugauugccccaagaggauauuucaagaucaggucuggcaaguccucaaucaugcggagugacgcgccgauugauaaauguaacagcgaaugcauaacacccaaugguuccaucccuaacgacaagccauuucagaaugucaaccgcauuaccuacgggcuuuguccccgauauguuaaacagaauacgcugaaguuggcaacuggaaugagaaacgugccugagaaacaaacaaggggcaucuucggcgccauagcuggguuuauugaaaauggaugggaggguaugauggauggcugguacggguuccggcaccagaacucugagggaaccggccaggccgcagaccucaagagcacucaagcugccaucaaucagaucaacgguaaacugaaucguuuaauugaaaagacaaacgagaaguuucaucagaucgaaaaagaguucucagaaguagaggggcgcauucaggaucuggagaaguauguggaagacaccaaaauagaucucuggaguuacaaugcggagcuucuggucgccuuggaaaaccaacacacgaucgaccuaaccgauuccgagaugaacaagcuguucgaaagaacuaaaaagcagcucagggagaaugcagaggacaugggcaacggaugcuuuaagauuuaucauaaaugugauaaugcuugcaucggcagcauccggaacgggacauacgaccacgacguguaccgagaugaagcccugaauaaccgcuuccagauuaagggaguugagcuuaaaucugguuauaaggacuggauacuguggaucucauuugcuauuaguugcuucuugcucuguaucgugcuguuaggcuuuauuaugugggccugccagaaagggaauaucagauguaacauaugcaucuga

SEQ ID NO: 122062 - RNA, 1701 nt, Artificial Sequence
  derived and/or modified sequence opt3 from hemagglutinin__InfluenzaA__AAX12801
augaagaccaucauugcccugagcuacauacucugccuuguguucgcucagaaauuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagacagaaucugcgauagcccacaccagauucuagacggugagaauuguacccucaucgaugcucugcuuggcgacccgcauugcgauggguuccagaacaaagaaugggaccuguuuguggagagguccaaggccuauucuaauuguuaccccuaugaugucccugacuacgugucguugcggucacucguugcaagcaguggaacucuggaguucaacaaugaauccuuuaacuggacaggcguggcccaaaaugguaccucuagcgcuugcaaacgccgauccgauaagucauucuuuagucgucugaacuggcuccaccaguuaaaguauaaauacccagcacugaaugucacgaugcccaacaaugagaaguucgacaaacuuuauauauggggagugcaucacccugggacugauagcgaccagaucucuuuguacgcccaggcuuccggcagaguaaccguuucaacaaagaggagccaacagacugugauuccaaacaucggcagucggcccuggguccgcggggugucuuccagaauuagcaucuacuggaccauagugaaaccuggagacauucugcuaaucaacucgacagguaaucucauugccccaaggggcuauuuuaagauccggucugggaaguccucaaucaugcgcagugaugcgccgauuggaaaauguaacagcgaaugcauaacccccaauggcuccaucccuaacgacaagccauuccagaaugucaaccgaauuacguacggugcaugucccagauauguuaaacagaauacucugaagcuggccacagggaugaggaacgugccugagaaacaaacccggggaaucuuuggcgcuauagccggcuucauugaaaaugggugggagggaaugauggaugguugguacggcuuucgucaccagaacucugaggggacuggacaggcagcugaccuuaagagcacacaagccgcgaucaaucagaucaacggcaaauugaaucgccucauugaaaagaccaacgagaaguuccaucagaucgaaaaagaguucucagaaguagaggguaggauucaggaucuggagaaguauguggaagacacgaaaauagauuuauggaguuacaaugccgagcugcucgucgcacuugaaaaccaacacaccaucgaccugacagauuccgagaugaacaaguuguuugaaagaacuaaaaagcagcuacgggagaaugcugaggacauggggaacggcugcuucaagauuuaucauaaaugugauaaugccugcaucggaagcauccgaaacggcaccuacgaccacgacguguaccgcgaugaagcucugaauaacagauuucagauuaaggggguugagcucaaaucuggauauaaggacuggauacuguggaucucauucgccauuaguugcuuucuucuguguaucguguugcucgguuucauuaugugggcaugccagaaaggcaauaucagguguaacauaugcaucuga

SEQ ID NO: 122063 - RNA, 1701 nt, Artificial Sequence
  derived and/or modified sequence opt3 from hemagglutinin__InfluenzaA__AAX12811
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucucggcccuggguccgcgggguguccagcagaauuucgaucuacuggaccauagugaaaccuggagacauucuacucaucaacucuacagguaaucugauugccccaaggggcuauuucaagauccgguccgggaagucaaguaucaugcgcagcgacgcgccgauuggaaaauguaacuccgaaugcauaacccccaauggcucuaucccuaacgauaagccauuucagaaugucaaccgaauuacguacggugcaugucccagauauguuaaacagaauacucuuaagcuggccacagggaugaggaacgugccugagaaacaaacccggggaaucuucggcgcuauagccggcuuuauugaaaaugggugggagggaaugauggacgguugguacggcuuccgucaccagaacagcgaggggacuggacaggcagcugauuugaagucaacacaagccgcgaucaaucagaucaacggcaaacucaaucgccugauugaaaagaccaacgagaaguuucaucagaucgaaaaagaguucagugaaguagaggguaggauucaggacuuagagaaguauguggaagauacgaaaauagaccugugguccuacaaugccgagcuccuugucgcacuggaaaaccaacacaccaucgauuugacagacagcgagaugaacaagcuauucgaaagaacuaaaaagcagcugcgggagaaugcugaggauauggggaacggcugcuuuaagauuuaucauaaaugugacaaugccugcaucggaucuauccgaaacggcaccuacgaucacgacguguaccgcgacgaagcucucaauaacagauuccagauuaaggggguugagcugaaaucaggauauaaggauuggauacuuuggaucaguuuugccauuagcugcuuccuguuguguaucgugcuccuggguuuuauuaugugggcaugccagaaaggcaauaucagguguaacauaugcaucuga

SEQ ID NO: 122064 - RNA, 1701 nt, Artificial Sequence
  derived and/or modified sequence opt3 from hemagglutinin__InfluenzaA__AAX34061
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucgacuggacagguguuacccagaacgggacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggaguccaccauccuggcacagacagcgaucagauuucuuuguacgcccaggcuuccggccguaucacugugucaaccaagagaagccaacagacaguaauuccaaacaucgggaguaggccccggguucgcgacgugucuuccagaauaagcauuuacuggaccaucgucaagccuggagacauucugcuaaucaacucgacggguaaucucaucgccccaaggggcuauuucaagauucggucugggaaauccucaauaaugcgcagugaugcgccgaucggaaaguguaacagcgaaugcauuacucccaauggcuccaucccuaacgacaaaccauuucagaaugugaaccgaauaacauacggugcaugucccagauauauuaagcagaauacccugaaacuugccacugggaugaggaacgugccugagaagcaaacacggggaaucuucggcgcuaucgccggcuuuauugaaaaugggugggagggaauggucgaugguugguacggcuuccgucaccagaacucugaggggaccggacaggcagcugaccugaaaagcacgcaagccgcgaucaaucagauuaacggcaaguugaaucgccucauagguaagaccaacgaaaaauuucaccagaucgagaaggaguucucagaaguugaagggaggauucaggaucuggagaaauauguggaggacacaaagaucgauuuauggaguuacaaugccgaacugcucguagcacuugagaaccaacauacuaucgaccugaccgauuccgaaaugaacaaauuguucgagagaacaaagaagcagcuacgggaaaaugcugaggacaugggcaacggaugcuuuaaaauuuaucacaagugugauaaugccugcauaggcagcauccgaaacgggacuuacgaccaugacguguaccgcgaugaggcucugaauaacagauuccagauuaaaggagucgaacucaagucugguuauaaagacuggauccuguggauuucauuugccaucaguugcuuccuucuguguguggcauugcucggcuuuauaaugugggccugccagaaggggaauaucagguguaacauuugcaucuga

SEQ ID NO: 122065 - RNA, 1701 nt, Artificial Sequence
  derived and/or modified sequence opt3 from hemagglutinin__InfluenzaA__AAX35821
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaaaucauuuuucagucgccugaauuggcucacucauuuaaaguauaaauacccagcacugaacgugaccaugcccaauaacgagaaguuugacaaacuuuauaucuggggcguccaccauccuggcacagauaacgaccagauuagcuuguacgcccaggcuucugggcgaaucacuguguccaccaagcguucacaacagacaguaauuccaaauaucggaagcagacccaggguucgggaugugaguucucgcauauccauuuacuggaccaucgucaagccuggugacauucugcuaaucaacagcacgggcaaucucaucgccccaagaggguauuucaaaauuaggucgggaaagucuuccauaaugcggucagacgcgccgaucggcaaauguaacagugagugcauuacucccaaugguagcaucccuaacgauaagccauuucagaaugugaaccgcauaacauacggggcauguccccgauaugugaaacagaauacccugaaacuugccacuggaaugagaaacgucccugaaaggcaaacacggggcauuuucggcgcuaucgccggguuuaucgagaauggaugggaagguaugguugacggcugguacggguuccgucaccagaacuccgagggaaccggccaggcagcugaucugaagucuacgcaagccgcgauuaaucagaucaacgguaaguugaaucgccucauugggaagaccaacgagaaauuucaccagauagaaaaggaguucagcgaaguggagggcagaauccaggaccuggaaaaauauguagaggauacaaagauugacuuauggucauacaacgccgagcugcucguggcacuugaaaaucaacauacuaucgaucugaccgacagugagaugaacaaauuguucgaaaggacaaagaagcagcuacgggagaaugcugaagauaugggaaacggcugcuuuaaaaucuaucacaagugugacaaugccugcauuggguccauacgaaacggaacuuacgaucaugacgucuaccgcgacgaggcucugaauaacagauuccagaucaaagguguggagcucaagagcggcuauaaagauuggauucuguggaucucuuuugccauuucaugcuuccuucuguguguugcauugcucggguuuaucaugugggccugccagaagggaaauauaagguguaacaucugcauuuga

SEQ ID NO: 122066 - RNA, 1701 nt, Artificial Sequence; identical to SEQ ID NO: 122047
  derived and/or modified sequence opt3 from hemagglutinin__InfluenzaA__AAX35831

SEQ ID NO: 122067 - RNA, 1701 nt, Artificial Sequence
  derived and/or modified sequence opt3 from hemagglutinin__InfluenzaA__AAX35851
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugcggagcuccuugucgcccuggaaaaccaacacaccaucgauuugacagacuccgagaugaacaagcuauucgaaagaacuaaaaagcagcugcgggagaaugcagaggauaugggcaacggaugcuuuaagauuuaucauaaaugugacaaugcuugcaucggcagcauccgaaacgggaccuacgaucacgacguguaccgcgacgaagcccucaauaacagauuccagauuaagggaguugagcugaaaucugguuauaaggauuggauacuuuggaucucauuugcuauuaguugcuuccuguuguguaucgugcuccugggcuuuauuaugugggccugccagaaagggaauaucagguguaacauaugcaucuga

SEQ ID NO: 122068 - RNA, 1701 nt, Artificial Sequence
  derived and/or modified sequence opt3 from hemagglutinin__InfluenzaA__AAX35861
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaauuaccguaagcacaaagaggagucaacagacuguuaucccaaacauuggcucugggcccugggugcggggagucuccagccgcaucucgauauacuggaccauugugaaaccuggugacauccuacucauuaacucuacaggcaaucugaucgccccaagaggguauuucaagaucagguccggaaagucaaguauuaugcggagcgacgcgccgauaggcaaauguaacuccgaaugcaucacccccaaugguucuauuccuaacgauaagccauuucagaaugugaaccgcaucacguacggggcauguccccgauaugucaaacagaauacucuuaagcuggccacaggaaugagaaacguuccugagaaacaaaccaggggcauauucggcgcuauugccggguuuaucgaaaauggaugggaggguaugauggacggcugguacggguuccggcaccagaacagcgagggaacuggccaggcagcugauuugaagucaacacaagccgcgaucaaucagauuaacgguaaacucaaucgucugaucgaaaagaccaacgagaaguuucaucagauugaaaaagaguucagugaaguggaggggcgcauacaggacuuagagaaguauguagaagauacgaaaaucgaccugugguccuacaaugccgagcuccuuguggcacuggaaaaccaacacaccauugauuugacagacagcgagaugaacaagcuauucgaaagaacuaaaaagcagcugagggagaaugcugaggauaugggcaacggaugcuuuaagaucuaucauaaaugugacaaugccugcaucggcucuauucggaacgggaccuacgaucacgacgucuaccgagacgaagcucucaauaaccgcuuccagauaaagggaguggagcugaaaucagguuauaaggauuggauccuuuggauuaguuuugccaucagcugcuuccuguuguguauuguucuccugggcuuuaucaugugggcaugccagaaagggaauauaagauguaacaucugcauuuga

SEQ ID NO: 122069 - RNA, 1701 nt, Artificial Sequence
  derived and/or modified sequence opt3 from hemagglutinin__InfluenzaA__AAX35871
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaagugcuagcagaaucugcgacuccccacaccagauucucgauggugagaauuguacacugaucgacgcccuucugggcgauccgcauugcgacggguuucagaacaaagaaugggauuuguucguggagaggucuaaggcauauucgaauuguuaccccuaugacgucccugauuacgugucacuccggagccugguugccaguuccggaacccuggaauuuaacaaugagucuuucaacuggacuggcguggcucaaaaugguaccagcuuugcaugcaaacgccgauccgacaagucauucuuuagucgucucaacugguuacaccagcugaaguauaaauacccagcccuuaaugucacaaugcccaacaaugagaaguucgauaaauuguauauauggggagugcaucacccugggacggacagcgaucagaucucucuguacgcucaggccuccggcagaguaacuguuucaaccaagaggagccaacagacagugauuccaaacaucggcagugggcccuggguccggggagugucuucccgcauuagcaucuacuggacuauagugaaaccuggugacauucuacucaucaacucgaccggcaaucugauugcgccaagaggguauuuuaagaucaggucuggaaaguccucaaucaugcggagugacgcaccgauuggcaaauguaacagcgaaugcauaacacccaaugguuccaucccuaacgauaagccauuccagaaugucaaccgcauuaccuacggggccuguccccgauauguuaaacagaauacgcuuaagcuggcuacuggaaugagaaacgugccugagaaacaaacaaggggcaucuuuggcgccauagcaggguucauugaaaauggaugggaggguaugauggacggcugguacggguuucggcaccagaacucugagggaaccggccaggcugccgaucuaaagagcacucaagcggccaucaaucagaucaacgguaaacucaaucgucugauugaaaagacaaacgagaaguuccaucagaucgaaaaagaguucucagaaguagaggggcgcauucaggacuuagagaaguauguggaagauaccaaaauagaccuguggaguuacaaugcagagcuccuugucgcucuggaaaaccaacacacgaucgauuugaccgacuccgagaugaacaagcuauuugaaagaacuaaaaagcagcugagggagaaugccgaggauaugggcaacggaugcuucaagauuuaucauaaaugugacaaugcuugcaucggcagcauccggaacgggacauacgaucacgacguguaccgagacgaagcccucaauaaccgcuuucagauuaagggaguugagcugaaaucugguuauaaggauuggauacuuuggaucucauucgcaauuaguugcuuucuguuguguaucgugcuccugggcuucauuaugugggccugccagaaagggaauaucagauguaacauaugcaucuga

SEQ ID NO: 122070 - RNA, 1701 nt, Artificial Sequence; identical to SEQ ID NO: 122063
  derived and/or modified sequence opt3 from hemagglutinin__InfluenzaA__AAX38237

SEQ ID NO: 122071 - RNA, 1701 nt, Artificial Sequence
  derived and/or modified sequence opt3 from hemagglutinin__InfluenzaA__AAX47515
augaaggccaucauugcucugagcuacauacucugccuuguguucgcacagaaacugcccggcaacgacaauuccaccgccacauuguguuuagggcaccaugcggucccuaacggaacucugguuaagacgaucaccaaugaucaaauugaggugacaaacgcuacugaauugguacagucuucaaguaccgguagaaucugcgacagcccacaccagauucucgauggcgagaauuguacacugaucgacgcccuucugggggauccgcauugcgacggauuucagaacaaagaaugggauuuguucguggagagguccaaggcauauucuaauuguuaccccuaugacgucccugauuacgugucgcuccggucacugguugccagcaguggcacccuggaauuuaacaaugaguccuucaacuggacugguguggcucaaaaugggacaucuagcgcaugcaaacgccgauccgacaagucauuuuucagucgucucaacugguuacaccagcugaaguauaaauacccagcccuuaaugucaccaugcccaacaaugagaaguuugauaaauuguauauauggggagugcaucacccuggcacggacagcgaucagaucucucuguacgcucaggccuccggcagaguaacuguuucaaccaagaggagccaacagacagugauuccaaacaucgggagucggcccuggguccgcggagugucuuccagaauuagcaucuacuggacuauagugaaaccuggugacauucuacucaucaacucgaccggcaaucugauugcgccaaggggguauuucaagauccggucuggaaaguccucaaucaugcgcagugacgcaccgauuggcaaauguaacagcgaaugcauaacacccaaugguuccaucccuaacgauaagccauuucagaaugucaaccgaauuaccuacggggccugucccagauauguuaaacagaauacgcuuaagcuggcuacuggaaugaggaacgugccugagaaacaaacacggggcaucuucggcgccauagcaggguuuauugaaaauggaugggaggguaugauggacggcugguacggguuccgucaccagaacucugagggaaccggccaggcugccgaucuaaagagcacucaagcggccaucaaucagaucaacgguaaacucaaucgccugauugaaaagacaaacgagaaguuucaucagaucgaaaaagaguucucagaaguagaggggaggauucaggacuuagagaaguauguggaagauaccaaaauagaccuguggaguuacaaugcagagcuccuugucgcucuggaaaaccaacacacgaucgauuugaccgacuccgagaugaacaagcuauucgaaagaacuaaaaagcagcugcgggagaaugccgaggauaugggcaacggaugcuuuaagauuuaucauaaaugugacaaugcuugcaucggcagcauccgaaacgggacauacgaucacgacguguaccgcgacgaagcccucaauaacagauuccagauuaagggaguugagcugaaaucugguuauaaggauuggauacuuuggaucucauuugcaauuaguugcuuccuguuguguaucgugcuccugggcuuuauuaugugggccugccagaaagggaauaucagguguaacauaugcaucuga

SEQ ID NO: 122072 - RNA, 1701 nt, Artificial Sequence
  derived and/or modified sequence opt3 from hemagglutinin__InfluenzaA__AAX47525
augaagaccaucauugcccugagcuacauacucugccuuguguucgcucagaaacugcccggcaacgacaauuccacagcaacuuuguguauggggcaccaugccgucccuaacggaacguuaguuaagaccaucacaaaugaucaaauugaggugacuaacgcgaccgaacugguacagucuucaaguacagguagaaucugcgacagcccacaccagauucuagauggcgagaauuguacccucaucgacgcucugcuuggggauccgcauugcgacggauuucagaacaaagaaugggaucuguucguggagagguccaaggccuauucuaauuguuaccccuaugacgucccugauuacgugucguugcggucacucguugcaagcaguggcacucuggaauuuaacaaugaguccuucaacuggacagguguggcccaaaaugggaccucuagcgcuugcaaacgccgauccaacaagucauuuuucagucgucugaauuggcuccaccaguuaaaguauaaauacccagcacugaacgucacgaugcccaauaacgagaaguuugacaaacuuuauauauggggagugcaucacccugauacugacagcaaccagaucucuuuguacgcccaggcuuccggcagaguaaccguuucaacaaagaggagccaacagacugugauuccaaauaucggcagugggcccuggguccggggagugucuucccgcauuagcaucuacuggaccauagugaaaccuggugauauucugcuaaucaacucgacaggcaaucucauugccccaagaggguauuucaagaucaggucuggaaaguccucaaucaugcggagugacgcgccgauuggcaaauguaacagcgaaugcauaacccccaaugguuccaucccuaacgacaagccauuucagaaugucaaccgcauuacguacggggcauguccccgauauguuaaacagaauacucugaagcuggccacaggaaugagaaacgugccugagaaacaaaccaggggcaucuucggcgcuauagccggguuuauugaaaauggaugggaggguaugauggauggcugguacggguuccggcaccagaacucugagggaacuggccaggcagcugaccuuaagagcacacaagccgcgaucaaucagaucaacgguaaauugaaucgucucauugaaaagaccaacgagaaguuucaucagaucgaaaaagaguucucagaaguagaggggcgcauucaggaucuggagaaguauguggaagacacgaaaauagauuuauggaguuacaacgccgagcugcucgucgcacuugaaaaucaacacaccaucgaccugacagauuccgagaugaacaaguuguucgaaagaacuaaaaagcagcuaagggagaaugcugaggacaugggcaacggaugcuuuaagauuuaucauaaaugugauaaugccugcaucggcagcauccggaacgggaccuacgaccacgauguguaccgagacgaagcucugaauaaccgcuuccagauuaagggaguugagcucaaaucugguuauaaggacuggauacuguggaucucauuugccauuaguugcuuccuucuguguaucguguugcucggcuuuauuaugugggcaugccagaaagggaauaucagauguaacauaugcaucuga

SEQ ID NO: 122073 - RNA, 1701 nt, Artificial Sequence; identical to SEQ ID NO: 122063
  derived and/or modified sequence opt3 from hemagglutinin__InfluenzaA__AAX47535

SEQ ID NO: 122074 - RNA, 1701 nt, Artificial Sequence; identical to SEQ ID NO: 122047
  derived and/or modified sequence opt3 from hemagglutinin__InfluenzaA__AAX56380

SEQ ID NO: 122075 - RNA, 1701 nt, Artificial Sequence; identical to SEQ ID NO: 122047
  derived and/or modified sequence opt3 from hemagglutinin__InfluenzaA__AAX56390

SEQ ID NO: 122076 - RNA, 1701 nt, Artificial Sequence
  derived and/or modified sequence opt3 from hemagglutinin__InfluenzaA__AAX56400
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcgagcggcgcuccaacaagucauuuuucagucgacugaauuggcucacucauuuaaaguauaaauacccagcacugaacgugaccaugcccaauaacgagaaguuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgauauaucuuccagaauuagcaucuacuggaccauugugaaaccuggugacauccugcuaaucaauucgacgggcaaccucauugccccaaggggguauuucaagauacggucuggaaaguccucaaucaugcgcagugacgcgccgauuggcaaauguaauagcgaaugcaucacucccaacgguuccauaccuaaugauaagccauuucagaacgucaaucgaauuacauacggggcaugucccagauaugugaaacagaacacccugaaacuugccacuggaaugaggaaugugccugagaaacaaacacggggcaucuucggcgcuaucgccggguuuauugaaaacggaugggaggguauggucgacggcugguacggguuccgucaccagaauagcgagggaaccggccaggcagcugaucugaagucuacgcaagccgcgaucaaccagauuaaugguaaauugaaccgccucauagggaagaccaaugaaaaguuucaccagaucgagaaagaguucucagaaguugaaggcaggauucaggaccuggagaaguauguggaggauacaaaaaucgacuuauggaguuacaacgccgaacugcucguagcacuugagaaccaacauacuaucgaucugaccgacuccgaaaugaauaaguuguucgagagaacaaagaagcagcuacgggaaaacgcugaggauaugggaaauggcugcuuuaagauuuaucacaaaugugacaacgccugcauagggagcauccgaaauggaacuuacgaucaugacguguaccgcgacgaggcucugaacaauagauuccagauuaagggugucgaacucaaaucuggcuauaaggauuggauccuguggauuucauuugccaucaguugcuuccuucuguguguggcauugcucggguuuauaaugugggccugccagaaaggaaacaucaggugugacauuugcaucuga

SEQ ID NO: 122077 - RNA, 1701 nt, Artificial Sequence; identical to SEQ ID NO: 122047
  derived and/or modified sequence opt3 from hemagglutinin__InfluenzaA__AAX56410

SEQ ID NO: 122078 - RNA, 1701 nt, Artificial Sequence
  derived and/or modified sequence opt3 from hemagglutinin__InfluenzaA__AAX56420
augaagaccaucauugcccugagcuacuuccucugccuuguguuugcucagaaacugcccggcaacgacaauuccacagcaacuuuguguuuagggcaccaugccgucccuaacggaacgauaguuaagaccaucacaaaugaucaaauugaggugacuaacgcgaccgaacugguacagucuucaaguacagguggcaucugcgacagcccacaccagauucuagauggggagaauuguacccucaucgacgcucugcuuggagauccgcagugcgacggcuuccaaaacaaaaagugggaucuguuuguggaaagauccaaagccuauucuaauuguuaccccuaugacgucccugauuacgcaucguugaggucacucguggccagcagugguacucuggaguucaacaaugaauccuuugacuggacagggguuacccagaacggaacgucuagcgcuugcaagcggcgcuccaauaagucauucuuuagucgacugaacuggcucacucauuuaaaauauaaguacccagcacugaaugugaccaugcccaacaaugagaaauucgauaaacuuuauauauggggcguccaccauccuggcacagacagcgaucagaucucuuuguacgcccaggcuuccgggcguauuacugugucaaccaagagaagccaacagacaguaaucccaaacauuggaaguaggccccggguucgcgacgugucuuccagaaucagcauauacuggaccauugucaagccuggugacauccugcuaauuaacucgacgggcaaucucaucgccccaaggggguauuuuaagauccggucuggaaaauccucaauuaugcgcagugaugcgccgauaggcaaguguaacagcgagugcaucacucccaaugguuccauuccuaacgacaaaccauuccagaaugugaaccgaaucacauacggggcaugucccagauaugugaagcagaauacccugaaacuugccacuggaaugaggaacgucccugaaaagcaaacacggggcauauuuggcgcuauugccggguucaucgagaauggaugggaagguaugguugauggcugguacggguuucgucaccagaacucugagggaaccggccaggcagcugaccugaaaagcacgcaagccgcgaucaaucagauuaacgguaaguugaaucgccucaucgggaagaccaacgagaaauuccaccagauugaaaaggaguucucagaaguggagggcagaauacaggaucuggaaaaauauguagaggacacaaagaucgauuuauggaguuacaaugccgagcugcucguggcacuugaaaaccaacauacuauugaccugaccgauuccgagaugaacaaauuguuugaaaggacaaagaagcagcuacgggagaaugcugaagacaugggaaacggcugcuucaaaaucuaucacaagugugauaaugccugcaucgggagcauucgaaacggaacuuacgaccaugacgucuaccgcgaugaggcucugaauaacagauuucagauaaaagguguggagcucaagucuggcuauaaagacuggauccuguggauuucauucgccaucaguugcuuucuucuguguguugcauugcucggguucauuaugugggccugccagaagggaaauaucagguguaacauaugcaucuga

SEQ ID NO: 122079 - RNA, 1701 nt, Artificial Sequence
  derived and/or modified sequence opt3 from hemagglutinin__InfluenzaA__AAX56430
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccgguggcauuugcgacagcccacaccagauccuagauggggagaauuguacucucauagacgcgcugcuuggagauccgcagugcgacggcuuucaaaacaaaaagugggaucuguucguggaaagauccaaggcuuauucuaauuguuaccccuaugacgucccugauuacgccucguugaggucacucguggcaagcagugguacacuggaguuuaacaaugaauccuucaacuggaccgggguuacgcagaauggaacuucuagcgccugcgagcggcgcuccaacaagucauuuuucagucgacugaauuggcucacccauuuaaaguauaaauacccagcucugaacgugacaaugcccaauaacgagaaguuugacaaacuuuauaucuggggcguccaccauccuggcacugauagcgaccagauuucuuuguacgcacaggccuccgggcguaucaccgugucaacaaagagaagccaacagaccguaauuccaaacaucggaaguaggccccggguucgcgaugugucuuccagaauaagcauuuacuggacgaucgucaaaccuggugacauucugcuaaucaauucgacuggcaaccucaucgcuccaaggggguauuucaagauucggucuggaaaguccucaauaaugcgcagugacgccccgaucggcaaauguaauagcgaaugcauuacacccaacgguuccaucccuaaugauaagccauuucagaacgugaaucgaauaaccuacggggcgugucccagauaugugaaacagaacacucugaaacuugcaacaggaaugaggaaugucccugagaaacaaacccggggcauuuucggcgccaucgcuggguuuaucgaaaacggaugggaggguaugguugacggcugguacggguuccgucaccagaauagcgagggaacgggccaggccgcagaucugaagucuacccaagcugccauuaaccagaucaaugguaaauugaaccgccucauugggaagacaaaugaaaaguuucaccagauagagaaagaguucucagaaguggaaggcagaauccaggaccuggagaaguauguagaggauacuaaaauugacuuauggaguuacaacgcggaacugcucguggcccuugagaaccaacauaccaucgaucugacagacuccgaaaugaauaaguuguucgagaggacuaaaaagcagcuacgggaaaacgcagaggauaugggaaauggcugcuuuaagaucuaucacaaaugugacaacgcuugcauugggagcauacgaaauggaaccuacgaucaugacgucuaccgcgacgaggcccugaacaauagauuccagaucaaggguguggaacucaaaucuggcuauaaggauuggauucuguggaucucauuugcuauuaguugcuuccuucuguguguugccuugcucggguuuaucaugugggcaugccagaaaggaaacauaaggugugacaucugcauuuga

SEQ ID NO: 122080 - RNA, 1701 nt, Artificial Sequence
  derived and/or modified sequence opt3 from hemagglutinin__InfluenzaA__AAX56440
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuucaacagguagaaucugcgacaguccacaccagauucucgauggcgagaacuguacccugaucgacgcucuacugggggauccgcauugcgacggauuucagaauaaagaaugggauuuguucguggagaggagcaaggccuauuccaacuguuaccccuaugacgucccugauuacgugucucuccggucgcugguugcaucaagcggcacucuggaauuuaauaacgagaguuucaauuggacagguguggcccagaacgggaccuccucugcuugcaaacgccgaagcgacaaguccuuuuucucacgucucaauugguuacaccagcugaaguauaaauacccagcacuuaacgucacgaugcccaauaacgagaaguuugauaaauuguauauauggggagugcaucacccuggcacugacaacgaucagaucagucuguacgcccaggcuagcggcagaguaaccguuucuacaaagaggucccaacagacugugauuccaaauaucgggucaggacccuggguccggggugugagcagucgcauuucuaucuacuggaccauagugaaaccuggcgacauucuacucaucaacuccacagggaaucugauugccccaagaggauauuucaagaucaggagcggcaagucgucuaucaugcgguccgacgcgccgauugguaaauguaacucagaaugcauaacccccaaugggaguaucccuaacgauaagccauuucagaaugucaaccgcauuacguacggacccuguccucgauauguuaaacagaauacucuuaagcuggcaacaggcaugagaaacgugccagagaaacaaaccaggggcaucuucggggccauagcuggauuuauugaaaaugguugggagggcaugauggacgggugguacggauuccggcaccagaacagcgagggcacuggucaggccgcagauuugaaguccacacaagcugccaucaaucagaucaacgggaaacucaaucgucugauugaaaagaccaacgagaaguuucaucagaucgaaaaagaguucucugaaguagagggccgcauucaggacuuagagaaguauguggaagauacgaaaauagaccuguggagcuacaacgcggagcuccuugucgcccuggaaaaucaacacaccaucgauuugacagacucagagaugaacaagcuauucgaaagaacuaaaaagcagcugagggagaaugcagaggauaugggaaacggcugcuuuaagauuuaucauaaaugugacaaugcuugcaucgggaguauccggaacggaaccuacgaucacgacguguaccgagacgaagcccucaauaaccgcuuccagauuaaggguguugagcugaaauccggcuauaaggauuggauacuuuggaucagcuuugcuauuucuugcuuccuguuguguaucgugcuccugggguuuauuaugugggccugccagaaaggaaauaucagauguaacauaugcaucuga

SEQ ID NO: 122081 - RNA, 1701 nt, Artificial Sequence; identical to SEQ ID NO: 122063
  derived and/or modified sequence opt3 from hemagglutinin__InfluenzaA__AAX56450

SEQ ID NO: 122082 - RNA, 1701 nt, Artificial Sequence
  derived and/or modified sequence opt3 from hemagglutinin__InfluenzaA__AAX56460
augaagaccaucauugcccugagcuacauacucugccuuguguucgcucagaaacugcccgagaacgacaauuccacagcaacuuuguguuuaggccaccaugccgucccuaacgggacgcugguuaagaccaucacaaaugaucaaauugaagugacuaacgcgaccgagcuaguacagucuucaaguacaggaagaaucugcgacagcccacaccagauucucgauggugaaaauuguacccugaucgacgcuuugcugggcgauccgcauugcgacggguuucagaacaaagagugggauuuguucguggaaagguccaaggccuauucuaauuguuaccccuaugacgucccugauuacgugucgcuccggucacugguugcaagcaguggaacucuggaguuuaacaaugaguccuucaacuggacaggcguggcccaaaaugguaccucuagcgcuugcaaacgccgauccgacaagucauuuuucagucgucucaacugguuacaccagcugaaguauaaauacccagcacuuaaugucacgaugcccaacaaugaaaaguuugauaaauuguauauauggggagugcaucacccugggacugacagcgaucagaucucucuguacgcccaggcuuccggcagaguaaccguuucaacaaagaggagccaacagacugugauuccaaacaucggcagucggcccuggguccgcggggugucuuccagaauuagcaucuacuggaccauagugaaaccuggagacauucuacucaucaacucgacagguaaucugauugccccaaggggcuauuucaagauccggucugggaaguccucaaucaugcgcagugacgcgccgauuggaaaauguaacagcgagugcauaacccccaauggcuccaucccuaacgauaagccauuucagaaugucaaccgaauuacgcacggucccuguccuagauacguuaaacagaauacucuuaagcuggcaacagggaugaggaacgugccagaaaaacaaacccggggaaucuucggcgccauagcuggcuuuauugagaaugggugggagggaaugauggacgguugguauggcuuccgucaucagaacucugaagggacuggacaggccgcagaucuuaagagcacacaagcugccaucaaucagaucaacggcaaacucaaucgccugauugagaagaccaacgaaaaguuucaccagaucgagaaagaguucucagaaguagaggguaggauucaggacuuagaaaaguacguggaggauacgaaaauagaccuguggaguuauaaugcggaacuccuugucgcccuggagaaccaacauaccaucgauuugacagacuccgaaaugaacaagcuauucgagagaacuaaaaagcagcugcgggagaaugcagaagauauggggaacggcugcuuuaagauuuaccacaaaugugacaaugcuugcaucggaagcauccgaaacggcaccuaugaucacgacguguaccgcgacgaggcccucaauaacagauuccagauuaaggggguugaacugaaaucuggauacaaggauuggauacuuuggaucucauuugcuauuaguugcuuccuguuguguaucgugcuccuggguuuuauuaugugggccugccagaaaggcaauaucagguguaacauaugcaucuga

SEQ ID NO: 122083 - RNA, 1701 nt, Artificial Sequence
  derived and/or modified sequence opt3 from hemagglutinin__InfluenzaA__AAX56470
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagaugcggucuggaaaguccucaaucaugcgcagugacgcgccgaucggcaaauguaacagcgaaugcauuacccccaaugguuccauaccuaacgauaagccauuucagaaugucaaccgaaucacguacgggcccuguccuagauauguuaaacagaauacucuuaagcuggcaacaggaaugaggaacgugccagagaaacaaacccggggcauuuucggcgccaucgcuggguuuauagaaaauggaugggaggguaugauggacggcugguacggguuccgucaccagaacucugagggaacuggccaggccgcagaucuaaagagcacacaagcugccauuaaucagaucaacgguaaacucaaucgccugaucgaaaagaccaacgagaaguuucaucagauugaaaaagaguucucagaaguagaggggagaauccaggacuuagagaaguauguggaagauacgaaaauugaccuguggaguuacaaugcggagcuccuugucgcccuggaaaaccaacacaccauagauuugacagacuccgagaugaacaagcuauucgaaaggacuaaaaagcagcugcgggagaaugcagaggauaugggcaacggaugcuuuaagaucuaucauaaaugugacaaugcuugcauuggcagcauccgaaacgggaccuacgaucacgacguguaccgcgacgaagcccucaauaacagauuccagaucaagggaguugagcugaaaucugguuauaaggauuggauucuuuggauaucauuugcuaucaguugcuuccuguuguguauugugcuccugggcuuuaucaugugggccugccagaaagggaauauuagguguaacaucugcauauga

SEQ ID NO: 122084 - RNA, 1701 nt, Artificial Sequence; identical to SEQ ID NO: 122067
  derived and/or modified sequence opt3 from hemagglutinin__InfluenzaA__AAX56480

SEQ ID NO: 122085 - RNA, 1701 nt, Artificial Sequence
  derived and/or modified sequence opt3 from hemagglutinin__InfluenzaA__AAX56510
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccaaaauuagcaucuacuggaccauagugaagccuggugacauucuacucaucaacucgacaggcaaucugauugccccaagaggguauuucaagaucaggucuggaaaauccucaaucaugcggagugacgcgccgauuggcaaguguaacagcgaaugcauaacccccaaugguuccaucccuaacgauaaaccauuucagaaugucaaccgcauuacguacggggcauguccccgauauguuaagcagaauacucuuaaacuggccacaggaaugagaaacgugccugagaagcaaaccaggggcaucuucggcgcuauagccggguuuauugaaaauggaugggaggguaugauggacggcugguacggguuccggcaccagaacucugagggaacuggccaggcagcugauuugaaaagcacacaagccgcgaucaaucagaucaacgguaagcucaaucgucugauugaaaagaccaacgagaaauuucaucagaucgaaaaggaguucucagaaguagaggggcgcauucaggacuuagagaaauauguggaagauacgaagauagaccuguggaguuacaaugccgagcuccuugucgcacuggaaaaccaacacaccaucgauuugacagacuccgagaugaacaaacuauucgaaagaacuaagaagcagcugagggagaaugcugaggauaugggcaacggaugcuuuaaaauuuaucauaagugugacaaugccugcaucggcagcauccggaacgggaccuacgaucacgacguguaccgagacgaagcucucaauaaccgcuuccagauuaaaggaguugagcugaagucugguuauaaagauuggauacuuuggaucucauuugccauuaguugcuuccuguuguguaucgugcuccugggcuuuauuaugugggcaugccagaaggggaauaucagauguaacauaugcaucuga

SEQ ID NO: 122086 - RNA, 1701 nt, Artificial Sequence; identical to SEQ ID NO: 122063
  derived and/or modified sequence opt3 from hemagglutinin__InfluenzaA__AAX56520

SEQ ID NO: 122087 - RNA, 1701 nt, Artificial Sequence
  derived and/or modified sequence opt3 from hemagglutinin__InfluenzaA__AAX56530
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucaauagccggcuggauccuggggaacccugagugcgaaaguuuguuuagcaaagaguccuggucuuacauugcagaaaccccaaauccgaagaacggaacuuguuaucccggcuacuucgccgacuaugaggagcucagggaacaacugucgucagucagcaguuuugagcgguucgaaaucuuuccuaaggauuccucuuggccaaaucauacagugaccaaagguguuacggcuagcugcucccacaacgggaagucaaguuucuacaaaaaucugcucugguuaacugagaagaacggacuguaucccaaucuuagcaaaucuuacgugaacaagaagggcaaagaggucuuggugcuguggggcguacaucacccuuccaauaugggggaccagcgcgcaauuuaccacaaggaaaacgccuauguuucagugcuaagcagucauuacucucgacguuuuaccccagagaucgcuaaaagacccaaggucagggaucaggaaggacggauaaacuauuacuggacacuccuggagccuggugacacuaucauuuucgaagccaauggcaaccuuaucgcgccaugguaugcauuugcccugucccgcggguucggaagcggcauuaucauaucgaaugcuucuaugggugagugugaugccaaaugccagaccccgcaaggggcaauuaacuccucauugcccuuucagaaugugcacccugugacaaucggagaguguccaaaguacgucagaaguaccaaacucaggaugguuacgggccugcggaacgugcccagcauucagucccgcggcuuauucggggcuaucgccggauuuaucgaagguggcuggacugggaugauugacggaugguauggcuaccaucaccagaaugagcaagguucuggguacgcggccgaucagaaaagcacacagaacgcaauaaauggcaucaccaacaagguaaauucaauuaucgaaaagaugaacacucaguucacagcugugggaaaggaguucaauaaacuggaaaagcgaauggagaaccucaauaaaaaggucgacgauggcuuucuugacauauggaccuauaacgccgagcuguuggugcuacuggaaaacgagagaacgcucgacuuccacgaucugaauguuaagaaccuuuacgaaaaagugaagaaucaacugaaaaacaaugcuaaggagauugggaacggaugcuuugaguucuaucauaaauguaauaacgaaugcauggagagugucaagaaugguaccuacgacuauccuaaguacuccaaagaaagcaaguugaacagggagaaaaucgauggcgugaagcucgaaucuauggggguauaucagauccuggccauuuacucaacaguugcaaguagcuuagugcugcuagucucccucggagccaucucuuuuuggaugugcucgaauggcagccugcagugucggauuugcauauga

SEQ ID NO: 122088 - RNA, 1701 nt, Artificial Sequence
  derived and/or modified sequence opt3 from hemagglutinin__InfluenzaA__AAX56550
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgauuugaaaucaacccaggcggccaucaaccaaauuaauggaaagcucaaccgccugaucgagaaaacgaaugaaaaguuucaccagauugaaaaggaguucagugaaguggagggcagaauacaggacuuagagaaauaugucgaagauaccaagaucgaccugugguccuacaacgcagagcuccuuguggcucuggaaaaccagcauacaauugauuugacugacagcgagaugaauaaacuauucgaaaggacccggaagcaacugcgagagaacgccgaggauauggguaaugggugcuuuaaaaucuaucacaagugugacaacgcuugcaucggcucuauucgcaauggaacauacgaucacgacguuuacagagaugaagcccucaacaauagguuccagauaaagggcguggagcugaaaucaggguauaaggacuggauccuuuggauuaguuuugcaaucagcugcuuccuguugugugucgugcuccugggauuuauuaugugggccugccagaaagguaacauccgguguaauauaugcaucuga

SEQ ID NO: 122089 - RNA, 1701 nt, Artificial Sequence
  derived and/or modified sequence opt3 from hemagglutinin__InfluenzaA__AAX56560
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacagugaucagaucagcuuguacgcccaggcuucugggcguauuacuguguccaccaagagaucacaacagacaguaaucccaaacauaggaagcaggccccggguucgcgacgugaguucuagaauuuccaucuacuggaccauugucaagccuggugacauccugcuaaucaacagcacgggcaaucucauugccccaaggggguauuucaagauacggucgggaaaaucuuccaucaugcgcucagaugcgccgauuggcaaguguaacagugagugcaucacucccaaugguagcauaccuaacgacaaaccauuucagaaugugaaccgaauuacauacggggcaugucccagauaugugaagcagaauacccugaaacuugccacuggaaugaggaacgucccugaaaagcaaacacggggcaucuucggcgcuaucgccggguuuauugagaauggaugggaagguaugguugauggcugguacggguuccgucaccagaacuccgagggaaccggccaggcagcugaccugaaaucuacgcaagccgcgaucaaucagauuaacgguaaguugaaucgccucauagggaagaccaacgagaaauuucaccagaucgaaaaggaguucagcgaaguggagggcaggauucaggaucuggaaaaauauguagaggacacaaagaucgauuuauggucauacaaugccgagcugcucguggcacuugaaaaccaacauacuaucgaccugaccgauagugagaugaacaaauuguucgaaagaacaaagaagcagcuacgggagaaugcugaagacaugggaaacggcugcuuuaaaauuuaucacaagugugauaaugccugcauaggguccauccgaaacggaacuuacgaccaugacgucuaccgcgaugaggcucugaauaacagauuccagauuaaagguguggagcucaagagcggcuauaaagacuggauccuguggauuucuuuugccaucucaugcuuccuucuguguguugcauugcucggguuuauaaugugggccugccagaagggaaauaucagguguaacauuugcaucuga

SEQ ID NO: 122090 - RNA, 1701 nt, Artificial Sequence
  derived and/or modified sequence opt3 from hemagglutinin__InfluenzaA__AAX56570
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucucggcccuggguccgcgggguguccagcggaauuucgaucuacuggaccauagugaaaccuggugacauucuacucaucaacucuacaggcaaucugauugccccaagaggguauuucaagaucagguccggaaagucaaguaucaugcggagcgacgcgccgauuggcaaauguaacuccgaaugcauaacccccaaugguucuaucccuaacgauaagccauuucagaaugucaaccgcauuacguacggggcauguccccgauauguuaaacagaauacucuuaagcuggccacaggaaugagaaacgugccugagaaacaaaccaggggcaucuucggcgcuauagccggguuuauugaaaauggaugggaggguaugauggacggcugguacggguuccggcaccagaacagcgagggaacuggccaggcagcugauuugaagucaacacaagccgcgaucaaucagaucaacgguaaacucaaucgucugauugaaaagaccaacgagaaguuucaucagaucgaaaaagaguucagugaaguagaggggcgcauucaggacuuagagaaguauguggaagauacgaaaauagaccugugguccuacaaugccgagcuccuugucgcacuggaaaaccaacacaccaucgauuugacagacagcgagaugaacaagcuauucgaaagaacuaaaaagcagcugagggagaaugcugaggauaugggcaacggaugcuuuaagauuuaucauaaaugugacaaugccugcaucggcucuauccggaacgggaccuacgaucacgacguguaccgagacgaagcucucaauaaccgcuuccagauuaagggaguugagcugaaaucagguuauaaggauuggauacuuuggaucaguuuugccauuagcugcuuccuguuguguaucgugcuccugggcuuuauuaugugggcaugccagaaagggaauaucagauguaacauaugcaucuga

SEQ ID NO: 122091 - RNA, 1701 nt, Artificial Sequence
  derived and/or modified sequence opt3 from hemagglutinin__InfluenzaA__AAX56590
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccuucuacugacuccgaucagaucucacuguacgcccaggcuagcgggagaguaaccguuaguacaaagaggucucaacagacugugauuccaaacaucggcucccggcccuggguccgcggcgugagcucgagaauuucuaucuacuggaccauagugaaaccuggggacauucuacucaucaacuccacaggaaaucugauugccccaagggguuauuucaagauccggucaggcaagaguagcaucaugcgcuccgacgcgccgauugggaaauguaacucugaaugcauaacccccaauggaagcaucccuaacgauaagccauuucagaaugucaaccgaauuacguacggcgcaugucccagauauguuaaacagaauacucuuaagcuggccacagguaugaggaacgugccugagaaacaaacccgggggaucuucggagcuauagccggcuuuauugaaaauggcugggaggggaugauggacggaugguacgguuuccgucaccagaacucagagggcacugggcaggcagcugauuugaagaguacacaagccgcgaucaaucagaucaacggaaaacucaaucgccugauugaaaagaccaacgagaaguuucaucagaucgaaaaagaguucuccgaaguagagggcaggauucaggacuuagagaaguauguggaagauacgaaaauagaccuguggagcuacaaugccgagcuccuugucgcacuggaaaaccaacacaccaucgauuugacagacucugagaugaacaagcuauucgaaagaacuaaaaagcagcugcgggagaaugcugaggauauggguaacgggugcuuuaagauuuaucauaaaugugacaaugccugcaucggcucaauccgaaacggaaccuacgaucacgacguguaccgcgacgaagcucucaauaacagauuccagauuaagggcguugagcugaaaaguggguauaaggauuggauacuuuggaucagcuuugccauuuccugcuuccuguuguguaucgugcuccugggauuuauuaugugggcaugccagaaagguaauaucagguguaacauaugcaucuga

SEQ ID NO: 122092 - RNA, 1701 nt, Artificial Sequence; identical to SEQ ID NO: 122089
  derived and/or modified sequence opt3 from hemagglutinin__InfluenzaA__AAX56600

SEQ ID NO: 122093 - RNA, 1701 nt, Artificial Sequence
  derived and/or modified sequence opt3 from hemagglutinin__InfluenzaA__AAX57644
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccgucgugaagccuggugacauccugcuaauuaacucgacgggcaaucucaucgccccaaggggguauuucaagaugcggucuggaaaauccucaaucaugcgcagugaugcgccgauuggcaaguguaacagcgagugcauaacucccaaugguuccaucccuaacgacaaaccauuucagaaugugaaccgaauuacauacggggcaugucccagauaugucaagcagaauacccugaaacuugccacuggaaugaggaacguuccugaaaagcaaacacggggcaucuucggcgcuauagccggguuuauugagaauggaugggaagguaugguggauggcugguacggguuccgucaccagaacucugagggaaccggccaggcagcugaccugaaaagcacgcaagccgcgaucaaucagaucaacgguaaguugaaucgccucauugggaagaccaacgagaaauuucaccagaucgaaaaggaguucucagaaguagagggcaggauucaggaucuggaaaaauauguggaggacacaaagauagauuuauggaguuacaaugccgagcugcucgucgcacuugaaaaccaacauacuaucgaccugaccgauuccgagaugaacaaauuguucgaaagaacaaagaagcagcuacgggagaaugcugaagacaugggaaacggcugcuuuaaaauuuaucacaagugugauaaugccugcaucgggagcauccgaaacggaacuuacgaccaugacguguaccgcgaugaggcucugaauaacagauuccagauuaaagguguugagcucaagucuggcuauaaagacuggauacuguggaucucauuugccauuaguugcuuccuucuguguguggcauugcucggguuuaucaugugggccugccagaagggaaauauuagguguaacaucugcauauga

SEQ ID NO: 122094 - RNA, 1701 nt, Artificial Sequence; identical to SEQ ID NO: 122047
  derived and/or modified sequence opt3 from hemagglutinin__InfluenzaA__AAX57654

SEQ ID NO: 122095 - RNA, 1701 nt, Artificial Sequence; identical to SEQ ID NO: 122063
  derived and/or modified sequence opt3 from hemagglutinin__InfluenzaA__AAX57664

SEQ ID NO: 122096 - RNA, 1701 nt, Artificial Sequence
  derived and/or modified sequence opt3 from hemagglutinin__InfluenzaA__AAX57684
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucugggcccuggguccggggaguguccagccgcauuucgaucuacuggaccauagugaaaccuggugacauucuacucaucaacucuacaggcaaucugauugccccaagaggguauuucaagaucagguccggaaagucaaguaucaugcggagcgacgcgccgauuggcaaauguaacuccgaaugcauaacccccaaugguucuaucccuaacgauaagccauuucagaaugucaaccgcauuacguacggggcauguccccgauauguuaaacagaauacucuuaagcuggccacaggaaugagaaacgugccugagaaacaaaccaggggcaucuucggcgcuauagccggguuuauugaaaauggaugggaggguaugauggacggcugguacggguuccggcaccagaacagcgagggaacuggccaggcagcugauuugaagucaacacaagccgcgaucaaucagaucaacgguaaacucaaucgucugauugaaaagaccaacgagaaguuucaucagaucgaaaaagaguucagugaaguagaggggcgcauucaggacuuagagaaguauguggaagauacgaaaauagaccugugguccuacaaugccgagcuccuugucgcacuggaaaaccaacacaccaucgauuugacagacagcgagaugaacaagcuauucgaaagaacuaaaaagcagcugagggagaaugcugaggauaugggcaacggaugcuuuaagauuuaucauaaaugugacaaugccugcaucggcucuauccggaacgggaccuacgaucacgacguguaccgagacgaagcucucaauaaccgcuuccagauuaagggaguugagcugaaaucagguuauaaggauuggauacuuuggaucaguuuugccauuagcugcuuccuguuguguaucgugcuccugggcuuuauuaugugggcaugccagaaagggaauaucagauguaacauaugcaucuga

SEQ ID NO: 122097 - RNA, 1701 nt, Artificial Sequence; identical to SEQ ID NO: 122067
  derived and/or modified sequence opt3 from hemagglutinin__InfluenzaA__AAX57694

SEQ ID NO: 122098 - RNA, 1701 nt, Artificial Sequence; identical to SEQ ID NO: 122089
  derived and/or modified sequence opt3 from hemagglutinin__InfluenzaA__AAX57704

SEQ ID NO: 122099 - RNA, 1701 nt, Artificial Sequence; identical to SEQ ID NO: 122067
  derived and/or modified sequence opt3 from hemagglutinin__InfluenzaA__AAX57714

SEQ ID NO: 122100 - RNA, 1701 nt, Artificial Sequence; identical to SEQ ID NO: 122096
  derived and/or modified sequence opt3 from hemagglutinin__InfluenzaA__AAX57733

SEQ ID NO: 122101 - RNA, 1701 nt, Artificial Sequence
  derived and/or modified sequence opt3 from hemagglutinin__InfluenzaA__AAX57734
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcaauuccccacaccagauucucgacggugagaacuguacccugaucgaugcucuacugggcgacccgcauugcgauggguuucagaauaaagaaugggacuuguucguggagaggucuaaggccuauucgaacuguuaccccuaugaugucccugacuacgugucacuccggagccugguugcaaguuccggaacucuggaauuuaauaacgagucuuucaauuggacaggcguggcccaaaacgguaccagcuccgcuugcaaacgccgaucagauaagagcuuuuucagucgucucaauugguuacaccagcugaaguauaaauacccagcacuuaacgucacgaugcccaauaacgagaaguuugacaaauuguauauauggggagugcaucacccugggacugauucugaccagaucucccuguacgcccaggcuucaggcagaguaaccguuagcacaaagaggagucaacagacugugauuccaaacaucggcucugggcccuggguccggggaguguccagccgcauuucgaucuacuggaccauagugaaaccuggugauauucuacucaucaauucuacaggcaaccugauugccccaagaggguauuucaagaucagguccggaaagucaaguaucaugcggagcgacgcgccgauuggcaaauguaauuccgaaugcauaacccccaacgguucuaucccuaaugacaagccauuucagaacgucaaucgcauuacguacggggcauguccccgauauguuaaacagaacacucuuaagcuggccacaggaaugagaaaugugccugagaaacaaaccaggggcaucuucggcgcuauagccggguuuauugaaaacggaugggaggguaugauggauggcugguacggguuccggcaccagaauagcgagggaacuggccaggcagcugacuugaagucaacacaagccgcgaucaaccagaucaaugguaaacucaaccgucugauugaaaagaccaaugagaaguuucaucagaucgaaaaagaguucagugaaguagaggggcgcauucaggauuuagagaaguauguggaagacacgaaaauagaucugugguccuacaacgccgagcuccuugucgcacuggaaaaccaacacaccaucgacuugacagauagcgagaugaauaagcuauucgaaagaacuaaaaagcagcugagggagaacgcugaggacaugggcaauggaugcuuuaagauuuaucauaaaugugauaacgccugcaucggcucuauccggaaugggaccuacgaccacgauguguaccgagacgaagcucucaacaaucgcuuccagauuaagggaguugagcugaaaucagguuauaaggacuggauacuuuggaucaguuuugccauuagcugcuuccuguuguguaucgugcuccugggcuuuauuaugugggcaugccagaaagggaacaucagauguaauauaugcaucuga

SEQ ID NO: 122102 - RNA, 1701 nt, Artificial Sequence; identical to SEQ ID NO: 122088
  derived and/or modified sequence opt3 from hemagglutinin__InfluenzaA__AAX57744

SEQ ID NO: 122103 - RNA, 1701 nt, Artificial Sequence; identical to SEQ ID NO: 122088
  derived and/or modified sequence opt3 from hemagglutinin__InfluenzaA__AAX57764

SEQ ID NO: 122104 - RNA, 1701 nt, Artificial Sequence; identical to SEQ ID NO: 122088
  derived and/or modified sequence opt3 from hemagglutinin__InfluenzaA__AAX57774

SEQ ID NO: 122105 - RNA, 1701 nt, Artificial Sequence
  derived and/or modified sequence opt3 from hemagglutinin__InfluenzaA__AAX57784
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagaauagcucaacaaguagaaucugcgacagcccacaccagauucucgauggugagaacuguacccugaucgacgcucuacugggcgauccgcauugcgacggguuucagaauaaagaaugggauuuguucguggagagguccaaggccuauucuaacuguuaccccuaugacgucccugauuacgugucgcuccggucacugguugcaagcaguggaacucuggaauuuaauaacgaguccuucaauuggacaggcguggcccaaaacgguaccucuagcgcuugcaaacgccgauccgacaagucauuuuucagucgucucaauugguuacaccagcugaaguauaaauacccagcacuuaacgucacgaugcccaauaacgagaaguuugauaaauuguauauauggggagugcaucacccugggacugacagcgaucagaucucucuguacgcccaggcuuccggcagaguaaccguuucaacaaagaggagccaacagacugugauuccaaacaucggcagucggcccuggguccgcggggugucuuccagaauuagcaucuacuggaccauagugaaaccuggagacauucuacucaucaauucgacagguaaccugauugccccaaggggcuauuucaagauccggucugggaaguccucaaucaugcgcagugacgcgccgauuggaaaauguaauagcgaaugcauaacccccaacggcuccaucccuaaugauaagccauuucagaacgucaaucgaauuacguacggugcaugucccagauauguuaaacagaacacucuuaagcuggccacagggaugaggaaugugccugagaaacaaacccggggaaucuucggcgcuauagccggcuuuauugaaaacgggugggagggaaugauggacgguugguacggcuuccgucaccaaaauucugaggggacuggacaggcagcugauuugaagucuacacaggccgcgaucaaccagaucaauggcaaacucaaccgccugauugaaaagaccaaugagaaguuucaucagaucgaaaaagaguucucagaaguagaggguaggauucaggacuuagagaaguauguggaagauacgaaaauagaccuguggaguuacaacgccgagcuccuugucgcacuggaaaaccaacacaccaucgauuugacagacuccgagaugaauaagcuauucgaaagaacuaaaaagcagcugcgggagaacgcugaggauauggggaauggcugcuuuaagauuuaucauaaaugugacaacgccugcaucggaagcauccgaaauggcaccuacgaucacgacguguaccgcgacgaagcucucaacaauagauuccagauuaaggggguugagcugaaaucuggauauaaggauuggauacuuuggaucucauuugccauuaguugcuuccuguuguguaucgugcuccuggguuuuauuaugugggcaugccagaaaggcaacaucagguguaauauaugcaucuga

SEQ ID NO: 122106 - RNA, 1701 nt, Artificial Sequence
  derived and/or modified sequence opt3 from hemagglutinin__InfluenzaA__AAX57794
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauacauuggacaauugugaagccuggggauauccuacucauuaacucuaccggaaaucugaucgcgccaagggguuacuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuauggcgccugucccagauacguuaagcagaacacacuuaaacuggcuaccgguaugaggaaugugccugagaagcagacucgggggauauucggagccauugcaggcuuuaucgaaaacggcugggaggggaugguagacggaugguaugguuuccgucaccaaaauagcgagggcacagggcaggcugccgauuugaaaucaacccaggcggccaucaaccaaauuaauggaaagcucaaccgccugaucgagaaaacgaaugaaaaguuucaucagauugaaaaggaguucagugaaguggagggcagaauacaggacuuagagaaauacgucgaagauaccaagaucgaccugugguccuauaacgcagagcuccuuguggcucuggaaaaccagcacacaauugauuugacugacagcgagaugaauaaacuauucgaaaggacccggaagcaacugcgagagaacgccgaggauauggguaaugggugcuuuaaaaucuaccacaagugugacaacgcuugcaucggcucuauucgcaauggaacauaugaucaugacguuuacagagaugaagcccucaacaauagguuccagauaaagggcguggagcugaaaucaggguacaaggacuggauccuuuggauuaguuuugcaaucagcugcuuccuguugugugucgugcuccugggauuuauuaugugggccugccagaaagguaacauccgguguaauauaugcaucuga

SEQ ID NO: 122107 - RNA, 1701 nt, Artificial Sequence; identical to SEQ ID NO: 122088
  derived and/or modified sequence opt3 from hemagglutinin__InfluenzaA__AAX57814

SEQ ID NO: 122108 - RNA, 1701 nt, Artificial Sequence
  derived and/or modified sequence opt3 from hemagglutinin__InfluenzaA__AAX57824
augaagaccaucauugcccugagcuacauacucugcaugguguucgcucagaaacuucccgucaacgacaauuccacagcaacucuguguuugggccaccaugccguuccuaacgggacguuagugaagaccaucacaaaugaucacauugagguaacuaacgcgaccgaacuggugcaaucuucaaguacaggaagaaucugcgacagcccacaucagauucuagauggugagaauuguacccucaucgacgcucugcuuggcgauccgcacugcgacggguuucagaacaaagaaugggaucuguucgucgagagguccacugccuauucuaauuguuaccccuaugacgugccugauuacgcaucguugcggucacucguugccagcaguggaacacuggaauuuaacaaugaguccuucaacuggaccggcguggcucagaaugguacgucuagcgcaugcaagcgccgauccauaaaaucauuuuucagucgucugaacuggcuccaucaauuaaaguauaaguacccagcccugaaugucacuaugcccaacaaugagaaauuugacaaacuuuauaucuggggagugcaccacccuagcaccgauucugaccagauuuccuuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccugcuaauuaacucuaccggaaaucucaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacugaaacuugcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgaucugaaaucaacccaggcggccaucaaccaaauuaauggaaaguugaaccgccucaucgaaaagacgaaugagaaguuucaccagauugaaaaggaguucagugaaguggagggcagaauacaggaccuggagaaauaugucgaagauaccaagaucgacuuaugguccuacaacgcagagcugcucguggcucuugaaaaccagcauacaauugaucugacugacagcgagaugaauaaauuguucgaaaggacccggaagcaacuacgagagaacgccgaggauauggguaaugggugcuuuaaaaucuaucacaagugugacaacgcuugcaucggcucuauucgcaauggaacauacgaucacgacguuuacagagaugaagcccugaacaauagguuccagauaaagggcguggagcucaaaucaggguauaaggacuggauccuguggauuaguuuugcaaucagcugcuuccuucugugugucguguugcucggauuuauuaugugggccugccagaaagguaacauccgguguaauauaugcaucuga

SEQ ID NO: 122109 - RNA, 1701 nt, Artificial Sequence; identical to SEQ ID NO: 122088
  derived and/or modified sequence opt3 from hemagglutinin__InfluenzaA__AAX57834

SEQ ID NO: 122110 - RNA, 1701 nt, Artificial Sequence; identical to SEQ ID NO: 122088
  derived and/or modified sequence opt3 from hemagglutinin__InfluenzaA__AAX57844

SEQ ID NO: 122111 - RNA, 1701 nt, Artificial Sequence
  derived and/or modified sequence opt3 from hemagglutinin__InfluenzaA__AAX57864
augaagaccaucauugcccugagcuacuuccucugccuuguguuugcucagaaacugcccgucaacgacaauuccacagcaacuuuguguuuaggccaccaugccguuccuaacgggacgcuggugaagaccauaacaaaugaucacaucgagguaacuaacgcgaccgaacuugugcaaucuucaaguacaggaagaauuugcgacagcccacaucagauccucgauggugagaauuguacccugauugacgcucuacugggcgauccgcacugcgacggguuccagaacaaagaaugggauuuguuugucgagagguccacugccuauucuaauuguuaccccuaugacgugccugauuacgcaucgcuccggucacugguugccagcaguggaacacuggaguucaacaaugaauccuuuaacuggaccggcguggcucagaaugguacgucuagcgcaugcaagcgccgauccaucaaaucauucuuuagucgucucaacugguuacaucaacugaaguauaaguacccagcccuuaaugucacuaugcccaacaaugagaaauucgacaaguuguauauauggggagugcaccacccuagcaccgauucugaccagaucucccuguacgcucaggccucagggagaguaacaguuagcacuaaaaggagucagcaaaccgugauuccaaacaucggcucucggcccuggguccgcggcguguccagcagaauuucgaucuacuggacaauagugaagccuggggauauucuacucaucaacucuaccggaaaucugauugcgccaagggguuauuuuaaaauccgguccggcaagucaaguaucaugcgcagcaacgcaccgauugggaaguguaauuccgaaugcauaacgcccaacggaucuaucccuaaugacaaaccauuccagaacgucaaucgaauuacuuacggcgccugucccagauauguuaagcagaacacacuuaaacuggcuaccgguaugaggaaugugccugagaagcagacucgggggaucuuuggagccauagcaggcuucauugaaaacggcugggaggggaugguagacggaugguacgguuuucgucaucaaaauagcgagggcacagggcaggcugccgauuugaaaucaacccaggcggccaucaaccaaaucaauggaaagcucaaccgccugauugagaaaacgaaugaaaaguuccaccagaucgaaaaggaguucagugaaguggagggcaggauucaggacuuagagaaauaugucgaagauaccaagauagaccugugguccuacaacgcagagcuccuuguggcucuggaaaaccagcauacaaucgauuugacugacagcgagaugaauaaacuauuugaaagaacccggaagcaacugcgagagaacgccgaggauauggguaaugggugcuucaaaauuuaucacaagugugacaacgcuugcaucggcucuauccgcaauggaacauacgaucacgacguuuacagagaugaagcccucaacaauagguuucagauuaagggcguggagcugaaaucaggguauaaggacuggauacuuuggaucaguuucgcaauuagcugcuuucuguugugugucgugcuccugggauucaucaugugggccugccagaaagguaacauucgguguaauaucugcauauga

SEQ ID NO: 122112 - RNA, 1701 nt, Artificial Sequence; identical to SEQ ID NO: 122088
  derived and/or modified sequence opt3 from hemagglutinin__InfluenzaA__AAX57874

SEQ ID NO: 122113 - RNA, 1701 nt, Artificial Sequence; identical to SEQ ID NO: 122088
  derived and/or modified sequence opt3 from hemagglutinin__InfluenzaA__AAX57884

SEQ ID NO: 122114 - RNA, 1701 nt, Artificial Sequence
  derived and/or modified sequence opt3 from hemagglutinin__InfluenzaA__AAX57894
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagguccucgauggugagaauuguacccugauugacgcucuacugggcgauccgcacugcgacggguuucagaacaaagaaugggauuuguucguggagagguccacugccuauucuaauuguuaccccuaugacguuccugauuacgcaucgcuccggucacugguggccagcaguggaacacuggaauuuaacaaugaguccuucaacuggaccggcgucgcucagaaugguacgucuagcgcaugcaagcgccgauccaucaaaucauuuuucagucgucucaacugguuacaucaacugaaguauaaguacccagcccuuaaugugacuaugcccaacaaugagaaauuugacaaguuguauauauggggaguacaccacccuagcaccgauucugaccagaucucccuguacgcucaggccucagggagaguuacagugagcacuaaaaggagucagcaaaccgucauuccaaacaucggcucucggcccugggugcgcggcguguccagcagaauuucgaucuacuggacaauagucaagccuggggauauucuacucaucaacucuaccggaaaucugauugcgccaagggguuauuucaaaauccgguccggcaagucaaguaucaugcgcagcaacgcaccgauugggaaguguaauuccgaaugcauaacgcccaacggaucuaucccuaaugacaaaccauuucagaacguuaaucgaauuacuuacggcgccugucccagauaugugaagcagaacacacuuaaacuggcuaccgguaugaggaauguaccugagaagcagacucgggggaucuucggagccauagcaggcuuuauugaaaacggcugggaggggaugguggacggaugguacgguuuccgucaucaaaauagcgagggcacagggcaggcugccgauuugaaaucaacccaggcggccaucaaccaaaucaauggaaagcucaaccgccugauugagaaaacgaaugaaaaguuucaccagaucgaaaaggaguucagugaagucgagggcaggauucaggacuuagagaaauauguggaagauaccaagauagaccugugguccuacaacgcagagcuccuuguugcucuggaaaaccagcauacaaucgauuugacugacagcgagaugaauaaacuauucgaaagaacccggaagcaacugcgagagaacgccgaggauauggguaaugggugcuuuaaaauuuaucacaagugugacaacgcuugcaucggcucuauccgcaauggaacauacgaucacgacguguacagagaugaagcccucaacaauagguuccagauuaagggcgucgagcugaaaucaggguauaaggacuggauacuuuggaucaguuuugcaauuagcugcuuccuguugugugugguacuccugggauuuaucaugugggccugccagaaagguaacauucgguguaauaucugcauauga

SEQ ID NO: 122115 - RNA, 1701 nt, Artificial Sequence
  derived and/or modified sequence opt3 from hemagglutinin__InfluenzaA__AAX57924
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuuuugcaugcaagcgccgaagcauaaaauccuucuuuucacgucucaacugguuacaucaacugaaguauaaguacccagcccuuaaugucacuaugcccaacaaugagaaauucgacaaguuguauaucuggggagugcaccacccuaguaccgauagcgaccagauuucucuguacgcucaggccuccgggagaguaacaguuucaacuaaaaggagccagcaaaccgugaucccaaacauuggcagucggcccuggguccgcggcgugucuuccagaaucagcauauacuggacaauugugaagccuggggauauccuacucauuaacucgaccggaaaucugaucgcgccaagggguuauuuuaaaauccggucuggcaaguccucaauuaugcgcaguaacgcaccgauagggaaguguaauagcgaaugcaucacgcccaacggauccauuccuaaugacaaaccauuccagaacgucaaucgaaucacuuacggcgccugucccagauauguuaagcagaacacacuuaaacuggcuaccgguaugaggaaugugccugagaagcagacucgggggauauuuggagccauugcaggcuucaucgaaaacggcugggaggggaugguagacggaugguacgguuuucgucaucaaaauucugagggcacagggcaggcugccgauuugaaaagcacccaggcggccaucaaccaaauuaauggaaagcucaaccgccugaucgagaaaacgaaugaaaaguuccaccagauugaaaaggaguucucagaaguggagggcagaauacaggacuuagagaaauaugucgaagauaccaagaucgaccuguggaguuacaacgcagagcuccuuguggcucuggaaaaccagcauacaauugauuugacugacuccgagaugaauaaacuauuugaaaggacccggaagcaacugcgagagaacgccgaggauauggguaaugggugcuucaaaaucuaucacaagugugacaacgcuugcaucggcagcauucgcaauggaacauacgaucacgacguuuacagagaugaagcccucaacaauagguuucagauaaagggcguggagcugaaaucuggguauaaggacuggauccuuuggauuucauucgcaaucaguugcuuucuguugugugucgugcuccugggauucauuaugugggccugccagaaagguaacauccgguguaauauaugcaucuga

SEQ ID NO: 122116 - RNA, 1701 nt, Artificial Sequence; identical to SEQ ID NO: 122088
  derived and/or modified sequence opt3 from hemagglutinin__InfluenzaA__AAX57934

SEQ ID NO: 122117 - RNA, 1701 nt, Artificial Sequence
  derived and/or modified sequence opt3 from hemagglutinin__InfluenzaA__AAX57944
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggaguggacccuggguccggggugugucuucccgcauuagcaucuacuggaccauagugaaaccuggcgacauucuacucaucaacucgacagggaaucugauugccccaagaggauauuucaagaucaggucuggcaaguccucaaucaugcggagugacgcgccgauugguaaauguaacagcgaaugcauaacccccaauggguccaucccuaacggaaagccauuucagaaugucaaccgcauuacguacggcgcauguccccgauauguuaaacagaauacucuuaagcuggccacaggcaugagaaacgugccugagaaacaaaccagggggaucuucggagcuauagccgguuuuauugaaaauggcugggaggggaugauggauggaugguacggcuuccggcaccagaacucugaggguacugggcaggcagcugaccuaaagagcacacaagccgcgaucaaucagaucaacggcaaacucaaucgucugauugaaaagaccaacgagaaguuucaucagaucgaaaaagaguucucagaaguagagggacgcauucaggauuuagagaaguauguggaagacacgaaaauagaucuguggaguuacaaugccgagcuccuugucgcacuggaaaaccaacacaccaucgacuugacagauuccgagaugaacaagcuauucgaaagaacuaaaaagcagcugagggagaaugcugaggacaugggcaacgggugcuuuaagauuuaucauaaaugugauaaugccugcaucggaagcauccggaacgguaccuacgaccacgauguguaccgagacgaagcucucaauaaccgcuuccagauuaagucuguugagcugaaaucaggcuauaaggacuggauacuuuggaucaguuuugccauuagcugcuuccuguuguguaucgugcuccugggguuuauuaugugggcaugccagaaaggaaauaucagauguaacauaugcaucuga

SEQ ID NO: 122118 - RNA, 1701 nt, Artificial Sequence
  derived and/or modified sequence opt3 from hemagglutinin__InfluenzaA__AAX76623
augaagaccaucauugcccugagcuacauacucugccuuguguucgcucagaaacugcccggcaacgacaaguccacagcaacuuuguguuuagggcaccaugccgucccuaauggaacgaucguuaaaaccauuacaaacgaucaaaucgaggugacuaaugcgaccgaacugguacagucuucaaguacagguggcauuugcgacagcccacaccagauccuagauggggagaacuguacccucauagacgcucugcuuggagauccgcagugcgacggcuuucaaaauaagaaaugggaucuguucguggaaagauccaaggccuauucuaacuguuaccccuaugacgucccugauuacgcaucguugaggucacucguggccagcagugguacucuggaguuuaauaacgaauccuucgacuggacagggguuacccagaauggaacgucuagcgcuugcaagcggcgcuccaacaaaucauuuuucagucgacugaauuggcucacucauuuaaaguauaaauacccagcacugaacgugaccaugcccaauaacgagaaguuugauaaacuuuauaucuggggcguccaccauccuggcacagacagcgaucagauuucuuuguacgcccaggcuuccgggcguaucacugugucaaccaagagaagccaacagacaguaauuccaaauaucggaaguaggccccggguucgcgacauaucuuccagaauuagcaucuacuggaccauugugaagccuggugacauccugcuaaucaacucgacgggcaaccucauugccccaaggggguauuucaaaauacggucuggaaaguccucaaucaugcgcagugaugcgccgauuggcaaauguaauagcgagugcaucacucccaacgguuccauaccuaaugacaagccauuucagaacgucaaucgaauuacauacggggcaugucccagauaugugaaacagaacacccugaagcuggccacuggaaugaggaaugugccugaaaaacaaacacggggcaucuucggcgcuaucgccggguuuauugagaacggaugggaagguauggucgauggcugguacggguuccgucaccagaauagcgagggaaccggccaggcagcugaccuuaagagcacgcaagccgcgaucaaccagauuaaugguaaguugaaccgccucauagggaaaaccaaugagaaguuucaccagaucgaaaaagaguucucagaaguugagggcaggauucaggaucuggaaaaguauguggaggacacaaaaaucgauuuauggaguuacaacgccgagcugcucguagcacuugaaaaucaacauacuaucgaccugaccgauuccgagaugaacaaguuguucgaaagaacaaagaaacagcuacgggagaacgcugaagacaugggaaauggcugcuuuaagauuuaucacaaaugugauaacgccugcauagggagcauccgaaauggaacuuacgaccaugacguguaccgcgaugaggcucugaacaauagauuccagauuaagggugucgagcucaggucuggcuauaaagacuggauccuguggauuucauuugccaucaguugcuuccuucuguguguggcaucuuugggguuuauaaugugggccugccagaagggaaacauccgguguaauauuugcaucuga

SEQ ID NO: 122119 - RNA, 1701 nt, Artificial Sequence
  derived and/or modified sequence opt3 from hemagglutinin__InfluenzaA__AAX76643
augaagaccaucauugcccugagcuacuuccucugccuuguguuugcucagaaacugcccggcaacgacaauuccacagcaacuuuguguuuagggcaccaugccgucccuaacggaacgauaguuaagaccaucacaaaugaucaaauugaggugacuaacgcgaccgaacugguacagucuucaaguacagguggcaucugcgacagcccacaccagauucuagauggggagaauuguacccucaucgacgcucugcuuggagauccgcagugcgacggcuuccaaaacaaaaagugggaucuguuuguggaaagauccaaagccuauucuaauuguuaccccuaugacgucccugauuacgcaucguugaggucacucguggccagcagugguacucuggaguucaacaaugaauccuuuaacuggacagggguuacccagaauggaacgucuagcgcuugcgagcggcgcuccaacaagucauucuuuagucgacugaauuggcucacucauuuaaaguauaaauacccagcacugaacgugaccaugcccaauaacgagaaguucgacaaacuuuauauauggggcguccaccauccuggcacagauagcgaccagaucucuuuguacgcccaggcuuccgggcguauuacugugucaaccaagagaagccaacagacaguaaucccaaacauuggaaguaggccccggguucgcgaugugucuuccagaaucagcauauacuggaccauugucaaaccuggugacauccugcuaauuaauucgacgggcaaccucaucgccccaaggggguauuuuaagauccggucuggaaaguccucaauuaugcgcagugacgcgccgauaggcaaauguaauagcgaaugcaucacucccaacgguuccauuccuaaugauaagccauuccagaacgugaaucgaaucacauacggggcaugucccagauaugugaaacagaacacccugaaacuugccacuggaaugaggaaugucccugagaaacaaacacggggcauauuuggcgcuauugccggguucaucgaaaacggaugggaggguaugguugacggcugguacggguuucgucaccagaauagcgagggaaccggccaggcagcugaucugaagucuacgcaagccgcgaucaaccagauuaaugguaaauugaaccgccucaucgggaagaccaaugaaaaguuccaccagauugagaaagaguucucagaaguggaaggcagaauacaggaccuggagaaguauguagaggauacaaaaaucgacuuauggaguuacaacgccgaacugcucguggcacuugagaaccaacauacuauugaucugaccgacuccgaaaugaauaaguuguuugagaggacaaagaagcagcuacgggaaaacgcugaggauaugggaaauggcugcuucaagaucuaucacaaaugugacaacgccugcaucgggagcauucgaaauggaacuuacgaucaugacgucuaccgcgacgaggcucugaacaauagauuucagauaaaggguguggaacucaaaucuggcuauaaggauuggauccuguggauuucauucgccaucaguugcuuucuucuguguguugcauugcucggguucauuaugugggccugccagaaaggaaacaucaggugugacauaugcaucuga

SEQ ID NO: 122120 - RNA, 1701 nt, Artificial Sequence
  derived and/or modified sequence opt3 from hemagglutinin__InfluenzaA__AAX76653
augaagaccaucauugcccugagcuacuuccucugccuuguguuugcucagaaacugcccggcaacgacaauuccacagcaacuuuguguuuagggcaccaugccgucccuaacggaacgauaguuaagaccaucacaaaugaucaaauugaggugacuaacgcgaccgaacugguacagucuucaaguacagguggcaucugcgacagcccacaccagauucuagauggggagaauuguacccucaucgacgcucugcuuggagauccgcagugcgacggcuuccaaaacaaaaagugggaucuguuuguggaaagauccaaagccuauucuaauuguuaccccuaugacgucccugauuacgcaucguugaggucacucguggccagcagugguacucuggaguucaacaaugaauccuuuaacuggacagggguuacccagaauggaacgucuagcgcuugcgagcggcgcuccaacaagucauucuuuagucgacugaauuggcucacucauuuaaaguauaaauacccagcacugaacgugaccaugcccaauaacgagaaguucgacaaacuuuauauauggggcguccaccauccuggcacagauagcgaccagaucucuuuguuugcccaggcuuccgggcguauuacugugucaaccaagagaagccaacagacaguaaucccaaacauuggaaguggucccaggguucgggaugugucuucccgcaucagcauauacuggaccauugucaaaccuggcgacauccugcuaauuaauucgacggggaaccucaucgccccaagaggauacuucaagaucaggucuggcaaguccucaauuaugcggagugacgcgccgauagguaaauguaauagcgaaugcaucacucccaacggguccauuccuaaugauaagccauuucagaacgugaaucgcaucacauauggagcauguccccgauacgugaaacagaacacccugaaacuugccacuggcaugagaaaugucccugagaaacaaacaaggggcauauucggggcuauugccggauuuaucgaaaacgguugggagggcaugguugacgggugguauggauuccggcaccagaauagcgagggcaccggucaggcagcugaucugaagucuacgcaagccgcgaucaaccagauuaaugggaaauugaaccgucucaucggcaagaccaaugaaaaguuccaccagauugagaaagaauuuucagagguggaaggacgcauacaggaccuggagaaguacguagaggauacaaaaaucgacuuauggaguuauaacgccgaacugcucguggcacuugagaaccaacauacuauugaucugaccgacuccgaaaugaauaaguuguucgagagaacaaagaagcagcuaagggaaaacgcugaggauaugggcaaugggugcuuuaagaucuaccacaaaugugacaacgccugcaucggaagcauucggaaugguacuuaugaucaugacgucuaccgagacgaggcucugaacaaucgcuuccagauaaagggcguggaacucaaaucuggguacaaggauuggauccuguggauuucauuugccaucaguugcuuccuucuguguguugcauugcucggauuuauuaugugggccugccagaaaggcaacaucagaugugacauaugcaucuga

SEQ ID NO: 122121 - RNA, 1701 nt, Artificial Sequence
  derived and/or modified sequence opt3 from hemagglutinin__InfluenzaA__AAX76663
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggaguggacccuggguccggggugugucuucccgcauuagcaucuacuggaccauagugaaaccuggcgacauucuacucaucaacucgacagggaaucugauugccccaagaggauauuucaagaucaggucuggcaaguccucaaucaugcggagugacgcgccgauugguaaauguaacagcgaaugcauaacccccaauggguccaucccuaacgauaagccauuucagaaugucaaccgcauuacguacggacccuguccucgauauguuaaacagaauacucuuaagcuggcaacaggcaugagaaacgugccagagaaacaaaccaggggcaucuucggggccauagcuggauuuauugaaaaugguugggagggcaugauggacgggugguacggauuccggcaccagaacucugagggcacuggucaggccgcagaucuaaagagcacacaagcugccaucaaucagaucaacgggaaacucaaucgucugauugaaaagaccaacgagaaguuucaucagaucgaaaaagaguucucagaaguagagggccgcauucaggacuuagagaaguauguggaagauacgaaaauagaccuguggaguuacaaugcggagcuccuugucgcccuggaaaaccaacacaccaucgauuugacagacuccgagaugaacaagcuauucgaaagaacuaaaaagcagcugagggagaaugcagaggauaugggaaacggcugcuuuaagauuuaucauaaaugugacaaugcuugcaucgggagcauccggaacggaaccuacgaucacgacguguaccgagacgaagcccucaauaaccgcuuccagauuaaggguguugagcugaaaucuggcuauaaggauuggauacuuuggaucucauuugcuauuaguugcuuccuguuguguaucgugcuccugggguuuauuaugugggccugccagaaaggaaauaucagauguaacauaugcaucuga

SEQ ID NO: 122122 - RNA, 1701 nt, Artificial Sequence
  derived and/or modified sequence opt3 from hemagglutinin__InfluenzaA__AAX76673
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgauuugaaaucaacccaggcggccaucaaccaaauuaauggaaagcucaaccgccugaucgagaaaacgaaugaaaaguuucaccagauugaaaaggaguucagugaaguggagggcagaauacaggacuuagagagguaugucgaagauaccaaaaucgaccugugguccuacaacgcagagcuccuuguggcucuggaaaaccagcauacaauugauuugacugacagcgagaugaauaagcuauucgaacggacccgaaaacaacugcgcgagaacgccgaggauauggguaaugggugcuuuaagaucuaucacaaaugugacaacgcuugcaucggcucuauuagaaauggaacauacgaucacgacguuuacagggaugaagcccucaacaaucgguuccagauaaagggcguggagcugaagucaggguauaaagacuggauccuuuggauuaguuuugcaaucagcugcuuccuguugugugucgugcuccugggauuuauuaugugggccugccagaaggguaacauccgcuguaauauaugcaucuga

SEQ ID NO: 122123 - RNA, 1701 nt, Artificial Sequence
  derived and/or modified sequence opt3 from hemagglutinin__InfluenzaA__AAX76683
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaagugucaugcgcagcaacgcaccgauugggaaguguaauuccgaaugcauaacgcccaacggaucuaucccuaaugacaaaccauuucagaacguuaaucgaauuacuuacggcgccugucccagauaugugaagcagaacacacuuaaacuggcuaccgguaugaggaauguaccugagaagcagacucgggggaucuucggagccauagcaggcuuuauugaaaacggcugggaggggaugguggacggaugguacgguuuccgucaucaaaauagcgagggcacagggcaggcugccgauuugaaaucaacccaggcggccaucaaccaaaucaauggaaagcucaaccgccugauugagaaaacgaaugaaaaguuucaccagaucgaaaaggaguucagugaagucgagggcaggauucaggacuuagagaaauauguggaagauaccaagauagaccugugguccuacaacgcagagcuccuuguugcucuggaaaaccagcauacaaucgauuugacugacagcgagaugaauaaacuauucgaaagaacccggaagcaacugcgagagaacgccgaggauauggguaaugggugcuuuaaaauuuaucacaagugugacaacgcuugcaucggcucuauccgcaauggaacauacgaucacgacguguacagagaugaagcccucaacaauagguuccagauuaagggcgucgagcugaaaucaggguauaaggacuggauacuuuggaucaguuuugcaauuagcugcuuccuguugugugugguacuccugggauuuaucaugugggccugccagaaagguaacauucgguguaauaucugcauauga

SEQ ID NO: 122124 - RNA, 1701 nt, Artificial Sequence; identical to SEQ ID NO: 122088
  derived and/or modified sequence opt3 from hemagglutinin__InfluenzaA__AAX76713

SEQ ID NO: 122125 - RNA, 1701 nt, Artificial Sequence
  derived and/or modified sequence opt3 from hemagglutinin__InfluenzaA__AAX76723
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugaggaauuugacaaauuguauaucuggggagugcaccacccuagcaccgauucugaccagauuucccuguacgcucaggccucagggagaguaacaguuagcacuaagaggagucagcaaaccgugaucccaaacauuggcucucggcccuggguccgcggcguguccagcaucauaucgauuuacuggacaaucgugaaaccuggggauauucuacucaucaacucuaccggaaaucugaucgcgccaagagguuauuucaagauuagguccggcaaaucaaguauaaugcggagcaacgcaccgaucgggaaguguaauuccgagugcauuacgcccaacggaucuaucccuaaugacaagccauuucagaacgucaaucgcauaacuuacggcgccuguccccgauauguuaaacagaacacacuuaagcuggcuaccgguaugagaaaugugccugaaaaacagacuagggggauuuucggagccaucgcaggcuuuaucgagaacggcugggaggggaugguagacggaugguacgguuuccggcaucaaaauagcgaaggcacagggcaggcugccgauuugaagucaacccaggcggccauuaaccaaaucaauggaaaacucaaccgucugauugagaagacgaaugaaaaauuucaccagauagagaaggaguucagugaaguggagggccgcauccaggacuuagaaaaguaugucgaggauaccaaaauugaccugugguccuacaacgcagaacuccuuguggcucuggagaaccagcauacaaucgauuugacugacagcgaaaugaauaagcuauucgagagaaccaggaaacaacugcgggagaacgccgaagauauggguaaugggugcuuuaagaucuaucacaaaugugacaacgcuugcauuggcucuauacgaaauggaacauacgaucacgacguuuaccgcgaugaggcccucaacaauagauuccagaucaagggcguggaacugaagucaggguauaaagacuggauucuuuggaucaguuuugcaauuagcugcuuccuguugugugucgugcuccugggauuuaucaugugggccugccagaaggguaacauaagguguaauaucugcauuuga

SEQ ID NO: 122126 - RNA, 1701 nt, Artificial Sequence
  derived and/or modified sequence opt3 from hemagglutinin__InfluenzaA__AAX76733
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagacagaaucugcgauagcccacaccagauucucgacgguggcaauuguacccugaucgaugcucuacugggggacccgcauugcgauggauuucagaacaaagagugggacuuguucguggaaagguccaaggccuauucuaauuguuaccccuaugaugucccugacuacgugucgcuccggucacugguugcaagcaguggcacucuggaguuuaacaaugaauccuucaacuggacagguguggcccaaaaugggaccucuagcgcuugcaaacgccgauccgauaagucauuuuucagucgucucaacugguuacaccagcugaagaauaaauauccagcacuuaacgucgccaugcccaauaacgagaaguuugacaaauuguacauauggggagugcaucacccuggcacggauagcgaccagaucucucuguaugcucaggccuccggcagaguaacuguuucaaccaagaggagccaacagacagugauuccaaacaucgggagucggccccgcgucagagacauuucuuccaggaucagcauauacuggacuauugugaaaccuggagauauccuacucauuaauucgaccgguaaccugaucgcgccacggggcuacuucaagauccgcucugggaaguccucaauuaugcgaagugacgcaccgauaggaaaauguaauagcgagugcaucacacccaacggcuccauuccuaaugauaagccauuucagaacgugaauagaaucaccuauggugccugucccagguacgucaaacagaacacgcuuaagcuggcuacugggaugcggaauguuccugaaaaacaaacacguggaauauucggcgccauugcaggcuuuaucgagaacgggugggaaggaaugguggacgguugguauggcuuccgccaccagaauuacgaggggaccggacaggcugccgauuugaagucuacucaagcggccaucaaccagauuaauggcaaacucaacagacugaucgagaagacaaaugaaaaguuucaucagauugagaaagaguucagcgaaguagaagguaggauacaggacuuagagaaguauguggaggauaccaaaaucgaccuguggucauacaacgcagaacuccuugucgcucuggagaaccaacacacgauugauuugaccgacagugaaaugaauaagcuauucgagcggacuaaaaagcagcugcgagaaaacgccgaggauauggggaauggcugcuuuaagaucuaucauaaaugugacaacgcuugcaucggauccauucgcaauggcacauacgaccacgauguguacagagacgaggcccucaacaauagguuccagauaaaggggguugaacugaaaagcggauauaaggauuggauccuuuggauuucuuuugcaaucucaugcuuccuguuguguauugugcuccuggguuuuaucaugugggccugccagaaaggcaacauacgguguaauaucugcauuuga

SEQ ID NO: 122127 - RNA, 1701 nt, Artificial Sequence
  derived and/or modified sequence opt3 from hemagglutinin__InfluenzaA__AAX76743
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccaacaagucauuuuucagucgucucaauugguuacaccagcugaagaacaaauauccagcacuuaaugucgccaugcccaacaacgagaaguuugacaaauuguacauauggggagugcaucacccuggcacggauagcgaccagaucucucuguaugcucaggccuccggcagaguaacuguuucaaccaagaggagccaacagacagugauuccaaauaucgggagucggccccgcgucagagauauuucuuccaggaucagcauauacuggacuauugugaaaccuggagacauccuacucauuaacucgaccgguaaucugaucgcgccacggggcuacuucaagauccgcucugggaaguccucaauuaugcgaagugacgcaccgauaggaaaauguaacagcgaaugcaucacacccaauggcuccauuccuaacgauaagccauuucagaaugugaacagaaucaccuauggugccugucccagguacgucaaacagaauacgcuuaagcuggcuacugggaugcggaacguuccugagaaacaaacacguggaauauucggcgccauugcaggcuuuaucgaaaaugggugggagggaaugauggacgguugguauggcuuccgccaccagaacucugaggggaccggacaggcugccgauuugaaaagcacucaagcggccaucaaucagauuaacggcaaacucaauagacugaucgaaaagacaaacgagaaguuucaucagauugaaaaagaguucucagaaguggaggguaggauacaggacuuagagaaguacguagaagauaccaaaaucgaccuguggaguuauaacgcagagcuccuuguggcucuggaaaaucaacacacgauugauuugaccgacuccgagaugaacaagcuauucgaacggacaaagaagcagcugcgagagaaugccgaggauauggggaacggcugcuuuaagaucuaccauaaaugugacaaugcuugcaucggaagcauucgcaacggcacuuaugaucacgacgucuacagagacgaagcccucaauaacagguuccagauaaaggggguggagcugaaaucuggauacaaggauuggauccuuuggauuucauuugcaaucaguugcuuccuguuguguauuguucuccuggguuuuaucaugugggccugccagaaaggcaauauacgguguaacaucugcauuuga

SEQ ID NO: 122128 - RNA, 1701 nt, Artificial Sequence
  derived and/or modified sequence opt3 from hemagglutinin__InfluenzaA__AAX76763
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacauaucuuccagaauuagcaucuacuggaccauugugaagccuggugacauccugcuaaucaacucgacgggcaaucucauugccccaaggggguauuucaagauacggucuggaaaauccucaaucaugcgcagugaugcgccgauuggcaaguguaacagcgagugcaucacucccaaugguuccauaccuaacgacaaaccauuucagaaugucaaccgaauuacauacggggcaugucccagauaugugaagcagaauacccugaaacuugccacuggaaugaggaacgugccugaaaagcaaacacggggcaucuucggcgcuaucgccggguuuauugagaauggaugggaagguauggucgauggcugguacggguuccgucaccagaacucugagggaaccggccaggcagcugaccugaaaagcacgcaagccgcgaucaaucagauuaacgguaaguugaaucgccucauagggaagaccaacgagaaauuucaccagaucgaaaaggaguucucagaaguugagggcaggauucaggaucuggaaaaauauguggaggacacaaagaucgauuuauggaguuacaaugccgagcugcucaucgcacuugaaaaccaacauacuauugaccugaccgauuccgagaugaacaaauuguucgaaagaacaaagaagcagcuacgggagaaugcugaagacaugggaaacggcugcuuuaaaauauaucacaagugugauaaugccugcaucgggagcauucgaaacggaacuuacgaccaugacguauaccgcgaugaggcucugaauaacagauuccagaucaaagguguggagcucaagucuggcuauaaagacuggauucuguggaucucauuugccauaaguugcuuccuucugugugucgcauugcucggguuuaucaugugggccugccagaagggaaauauuagguguaacaucugcauuuga

SEQ ID NO: 122129 - RNA, 1701 nt, Artificial Sequence; identical to SEQ ID NO: 122048
  derived and/or modified sequence opt3 from hemagglutinin__InfluenzaA__AAY18086

SEQ ID NO: 122130 - RNA, 1701 nt, Artificial Sequence
  derived and/or modified sequence opt3 from hemagglutinin__InfluenzaA__AAY18096
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacagucuucaaguacagguggcauuugugacagcccacaccagauccuagauggggagaauugcacccucauagacgcucugcuuggagauccgcagugugacggcuuucaaaacaaaaagugggaucuguucguggaaagauccaaagccuacucuaauugcuaucccuacgacgucccugauuaugcaucguugaggucacucguggccagcagugguacucuggaguuuaacaaugaauccuucaacuggacagggguuacccagaauggaacgucuagcgcuugugagcggcgcuccaacaagucauuuuucagucgacugaauuggcucacucauuuaaaguacaaauauccagcacugaacgugaccaugcccaauaacgagaaguuugacaaacuuuacaucuggggcguccaccauccuggcacagauagcgaccagauuucuuuguaugcccaggcuuccgggcguaucacugugucaaccaagagaagccaacagacaguaauuccaaacaucggaaguaggccccggguucgcgaugugucuuccagaauaagcauuuacuggaccaucgucaaaccuggugacauucugcuaaucaauucgacgggcaaccucaucgccccaaggggguacuucaagauucggucuggaaaguccucaauaaugcgcagugacgcgccgaucggcaaaugcaauagcgaauguauuacucccaacgguuccaucccuaaugauaagccauuucagaacgugaaucgaauaacauauggggcaugccccagauacgugaaacagaacacccugaaacuugccacuggaaugaggaaugucccugagaaacaaacacggggcauuuucggcgcuaucgccggguuuaucgaaaacggaugggaggguaugguugacggcugguauggguuccgucaccagaauagcgagggaaccggccaggcagcugaucugaagucuacgcaagccgcgauuaaccagaucaaugguaaauugaaccgccucauugggaagaccaaugaaaaguuucaccagauagagaaagaguucucagaaguggaaggcagaauccaggaccuggagaaguacguagaggauacaaaaauugacuuauggaguuauaacgccgaacugcucguggcacuugagaaccaacauacuaucgaucugaccgacuccgaaaugaauaaguuguucgagaggacaaagaagcagcuacgggaaaacgcugaggauaugggaaauggcuguuuuaagaucuaccacaaaugcgacaacgccugcauugggagcauacgaaauggaacuuaugaucaugacgucuaccgcgacgaggcucugaacaauagauuccagaucaaggguguggaacucaaaucuggcuacaaggauuggauucuguggaucucauuugccauuaguuguuuccuucugugcguugcauugcucggguuuaucaugugggccugucagaaaggaaacauaaggugcgacaucuguauuuga

SEQ ID NO: 122131 - RNA, 1701 nt, Artificial Sequence; identical to SEQ ID NO: 122063
  derived and/or modified sequence opt3 from hemagglutinin__InfluenzaA__AAY18106

SEQ ID NO: 122132 - RNA, 1701 nt, Artificial Sequence; identical to SEQ ID NO: 122063
  derived and/or modified sequence opt3 from hemagglutinin__InfluenzaA__AAY18116

SEQ ID NO: 122133 - RNA, 1701 nt, Artificial Sequence
  derived and/or modified sequence opt3 from hemagglutinin__InfluenzaA__AAY18126
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaaggguucaacuggacaggaguuacccagaauggcacguccucugcuugcaagcgcaagagcaacaaauccuuuuucucacggcugaauuggcucacucauuuaaaguauaaauacccagcacugaacgugaccaugcccaauaacgagaaguuugacaaacuuuauaucuggggcguccaccauccugggacagauaacgaccagauuaguuuguacgcccaggcuagcggacgaaucacugugucuaccaagcguucccaacagacaguaauuccaaauaucgguucaagacccaggguucgggaugugagcagucgcauaucuauuuacuggaccaucgucaagccuggcgacauucugcuaaucaacuccacggggaaucucaucgccccaagaggauauuucaaaauuaggagcggcaagucgucuauaaugcgguccgacgcgccgaucgguaaauguaacucagagugcauuacucccaaugggaguaucccuaacgauaagccauuucagaaugugaaccgcauaacauacggagcauguccccgauaugugaaacagaauacccugaaacuugccacuggcaugagaaacgucccugaaaagcaaacaaggggcauuuucggggcuaucgccggauuuaucgagaaugguugggaaggcaugguugacgggugguacggauuccggcaccagaacagcgagggcaccggucaggcagcugaucugaaguccacgcaagccgcgauuaaucagaucaacgggaaguugaaucgucucauuggcaaaaccaacgagaaguuucaccagauagaaaaagaguucucugaaguggagggacgcauccaggaccuggaaaaguauguagaggauacaaaaauugacuuauggagcuacaacgccgagcugcucguggcacuugaaaaucaacauacuaucgaucugaccgacucagagaugaacaaguuguucgaaagaacaaagaaacagcuaagggagaaugcugaagauaugggcaacgggugcuuuaagaucuaucacaaaugugacaaugccugcauuggaaguauacggaacgguacuuacgaucaugacgucuaccgagacgaggcucugaauaaccgcuuccagaucaagggcguggagcucaaauccggguauaaggauuggauucuguggaucagcuuugccauuucuugcuuccuucuguguguugcauugcucggauuuaucaugugggccugccagaagggcaauauaagauguaacaucugcauuuga

SEQ ID NO: 122134 - RNA, 1701 nt, Artificial Sequence
  derived and/or modified sequence opt3 from hemagglutinin__InfluenzaA__AAY18136
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauauauuaagcagaauacccugaaacuugccacuggaaugaggaacgugccugaaaagcaaacacggggcaucuucggcgcuaucgccggguuuauugagaauggaugggaagguauggucgauggcugguacggguuccgucaccagaacucugagggaaccggccaggcagcugaccugaaaagcacgcaagccgcgaucaaucagauuaacgguaaguugaaucgccucauagggaagaccaacgagaaauuucaccagaucgaaaaggaguucucagaaguugagggcaggauucaggaucuggaaaaauauguggaggacacaaagaucgauuuauggaguuacaaugccgagcugcucguagcacuugaaaaccaacauacuaucgaccugaccgauuccgagaugaacaaauuguucgaaagaacaaagaagcagcuacgggagaaugcugaagacaugggaaacggcugcuuuaaaauuuaucacaagugugauaaugccugcauagggagcauccgaaacggaacuuacgaccaugacguguaccgcgaugaggcucugaauaacagauuccagauuaaaggugucgagcucaagucuggcuauaaagacuggauccuguggauuucauuugccaucaguugcuuccuucuguguguggcauugcucggguuuauaaugugggccugccagaagggaaauaucagguguaacauuugcaucuga

SEQ ID NO: 122135 - RNA, 1701 nt, Artificial Sequence; identical to SEQ ID NO: 122088
  derived and/or modified sequence opt3 from hemagglutinin__InfluenzaA__AAY18156

SEQ ID NO: 122136 - RNA, 1701 nt, Artificial Sequence; identical to SEQ ID NO: 122088
  derived and/or modified sequence opt3 from hemagglutinin__InfluenzaA__AAY18176

SEQ ID NO: 122137 - RNA, 1701 nt, Artificial Sequence; identical to SEQ ID NO: 122088
  derived and/or modified sequence opt3 from hemagglutinin__InfluenzaA__AAY18186

SEQ ID NO: 122138 - RNA, 1701 nt, Artificial Sequence; identical to SEQ ID NO: 122089
  derived and/or modified sequence opt3 from hemagglutinin__InfluenzaA__AAY18564

SEQ ID NO: 122139 - RNA, 1701 nt, Artificial Sequence
  derived and/or modified sequence opt3 from hemagglutinin__InfluenzaA__AAY18585
augaagaccaucauugcccugagcuacauacucugccuuguguucgcucagaaacugcccgagaacgacaauuccacagcaacuuuguguuuaggccaccaugccgucccuaacgggacgcugguuaagaccaucacaaaugaucaaauugaagugacuaacgcgaccgagcuaguacagucuucaaguacaggaagaaucugcgacagcccacaccagauucucgauggugaaaauuguacccugaucgacgcuuugcugggcgauccgcauugcgacggguuucagaacaaagagugggauuuguucguggaaagguccaaggccuauucuaauuguuaccccuaugacgucccugauuacgugucgcuccggucacugguugcaagcaguggaacucuggaguuuaacaaugaguccuucaacuggacaggcguggcccaaaaugguaccucuagcgcuugcaaacgccgauccgacaagucauuuuucagucgucucaacugguuacaccagcugaaguauaaauacccagcacuuaaugucacgaugcccaacaaugaaaaguuugauaaauuguauauauggggagugcaucacccugggacugacagcgaucagaucucucuguacgcccaggcuuccggcagaguaaccguuucaacaaagaggagccaacagacugugauuccaaacaucggcagucggcccuggguccgcggggugucuuccagaauuagcaucuacuggaccauagugaaaccuggagacauucuacucaucaacucgacagguaaucugauugccccaaggggcuauuucaagauccggucugggaaguccucaaucaugcgcagugacgcgccgauuggaaaauguaacagcgagugcauaacccccaauggcuccaucccuaacgauaagccauuucagaaugucaaccgaauuacguacggucccuguccuagauauguuaaacagaauacucuuaagcuggcaacagggaugaggaacgugccagaaaaacaaacccggggaaucuucggcgccauagcuggcuuuauugagaaugggugggagggaaugauggacgguugguacggcuuccgucaccagaacucugaagggacuggacaggccgcagaucuuaagagcacacaagcugccaucaaucagaucaacggcaaacucaaucgccugauugagaagaccaacgaaaaguuucaucagaucgagaaagaguucucagaaguagaggguaggauucaggacuuagaaaaguauguggaggauacgaaaauagaccuguggaguuacaaugcggaacuccuugucgcccuggagaaccaacacaccaucgauuugacagacuccgaaaugaacaagcuauucgagagaacuaaaaagcagcugcgggagaaugcagaagauauggggaacggcugcuuuaagauuuaucauaaaugugacaaugcuugcaucggaagcauccgaaacggcaccuacgaucacgacguguaccgcgacgaggcccucaauaacagauuccagauuaaggggguugaacugaaaucuggauauaaggauuggauacuuuggaucucauuugcuauuaguugcuuccuguuguguaucgugcuccuggguuuuauuaugugggccugccagaaaggcaauaucagguguaacauaugcaucuga

SEQ ID NO: 122140 - RNA, 1701 nt, Artificial Sequence; identical to SEQ ID NO: 122048
  derived and/or modified sequence opt3 from hemagglutinin__InfluenzaA__AAY18611

SEQ ID NO: 122141 - RNA, 1701 nt, Artificial Sequence; identical to SEQ ID NO: 122089
  derived and/or modified sequence opt3 from hemagglutinin__InfluenzaA__AAY27843

SEQ ID NO: 122142 - RNA, 1701 nt, Artificial Sequence; identical to SEQ ID NO: 122048
  derived and/or modified sequence opt3 from hemagglutinin__InfluenzaA__AAY27853

SEQ ID NO: 122143 - RNA, 1701 nt, Artificial Sequence
  derived and/or modified sequence opt3 from hemagglutinin__InfluenzaA__AAY27863
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagaucauagauggggagaauuguacccuaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugguggccagcagugguacucucgaguuuaacaaugaauccuucgacuggacagggguuacccagaacggaacgucuagcgcuugcaagcggcgcuccaauaagucauuuuucagucgacugaacuggcugacucaucucaaauauaaguacccagcauuaaaugugaccaugcccaacaaugagaaauuugauaagcuguauauuuggggcguccaccauccuggcacagacagcgaucagaucucucuuuacgcccaggcuuccgggcguauuacugugucaaccaaaagaagccaacagacaguaaucccaaacauaggaaguaggccccggguucgcgacgugucuuccagaauuagcaucuacuggaccauugucaagccuggugacaucuugcugaucaacucgacgggcaaucuaauugccccaaggggguauuucaagauacggucuggaaaauccucaaucaugauuagugaugcgccgaucggcaaguguaacagcgagugcauaacucccaaugguuccauuccuaacgacaaaccauuucagaaugugaaccgcaucacauacggggcauguccccgauaugugaagcagaauacccucaaacuggccacuggaaugagaaacgucccugaaaagcaaacaaggggcaucuucggcgcuauugccggguuuaucgagaauggaugggaagguaugguugauggcugguacggguuccggcaccagaacucugagggaaccggccaggcagcugaccuuaaaagcacgcaagccgcgauuaaucagauaaacgguaagcugaaucguuugaucgggaagaccaacgagaaauuucaccagauugaaaaggaguucucagaaguggagggccgcauccaggaucucgaaaaauauguagaggacacaaagaucgaucuguggaguuacaaugccgaguuacugguggcacucgaaaaccaacauacuauugaccuuaccgauuccgagaugaacaaacuguucgaaagaacaaagaagcaguugagggagaaugcugaagacaugggaaacggcugcuuuaaaauauaucacaagugugauaaugccugcaucgggagcauucggaacggaacuuacgaccaugacgucuaccgagaugaggcucuaaauaaccgcuuccagaucaaagguguggagcugaagucuggcuauaaagacuggauucucuggaucucauuugccauaaguugcuuccugcuuuguguugcacuguugggguuuaucaugugggccugccagaagggaaauauuagauguaacaucugcauuuga

SEQ ID NO: 122144 - RNA, 1701 nt, Artificial Sequence; identical to SEQ ID NO: 122067
  derived and/or modified sequence opt3 from hemagglutinin__InfluenzaA__AAY27959

SEQ ID NO: 122145 - RNA, 1701 nt, Artificial Sequence; identical to SEQ ID NO: 122047
  derived and/or modified sequence opt3 from hemagglutinin__InfluenzaA__AAY27994

SEQ ID NO: 122146 - RNA, 1701 nt, Artificial Sequence; identical to SEQ ID NO: 122047
  derived and/or modified sequence opt3 from hemagglutinin__InfluenzaA__AAY28004

SEQ ID NO: 122147 - RNA, 1701 nt, Artificial Sequence; identical to SEQ ID NO: 122047
  derived and/or modified sequence opt3 from hemagglutinin__InfluenzaA__AAY28265

SEQ ID NO: 122148 - RNA, 1701 nt, Artificial Sequence
  derived and/or modified sequence opt3 from hemagglutinin__InfluenzaA__AAY28275
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaagugugaugcgcagcgacgcauccaucggaaaauguaauucugaaugcauuaccccgaacggcagcauacccaaugacaagccuuuucagaacgucaaucgaaucacguacggugccuguccaagauauguuaaacagaacacucuuaagcuggcuacagggaugaggaaugugcccgagaaacaaacccggggaauuuucggcgccaucgcaggcuuuauagaaaacgggugggagggaaugguagaugguugguacggcuuccgucaccagaauagcgaggggacuggacaggcugccgacuugaagaguacacaagcggccauuaaccagaucaauggcaaacucaaccgccugaucgaaaagaccaaugagaaguuucaucagauugaaaaagaguucuccgaaguggaggguagaauccaggauuuagagaaguaugucgaagacacgaaaauugaucuguggagcuacaacgcagagcuccuuguggcucuggaaaaccaacacaccauagacuugacagauucugagaugaauaagcuauucgaaaggacuaaaaagcagcugcgggagaacgccgaggacauggggaauggcugcuuuaagaucuaucauaaaugugauaacgcuugcauuggaucaauccgaaauggcaccuacgaccacgauguuuaccgcgacgaagcccucaacaauagauuccagaucaaggggguggagcugaaaaguggauauaaggacuggauucuuuggauaucauuugcaaucuccugcuuccuguugugugucgugcuccuggguuuuauuaugugggccugccagaaaggcaacaucagguguaauauuugcaucuga

SEQ ID NO: 122149 - RNA, 1701 nt, Artificial Sequence
  derived and/or modified sequence opt3 from hemagglutinin__InfluenzaA__AAY28285
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuucaacagguagaaucugcgacaguccacaccagauucucgauggcgagaacuguacccugaucgacgcucuacugggggauccgcauugcgacggauuucagaauaaagaaugggauuuguucguggagaggagcaaggccuauuccaacuguuaccccuaugacgucccugauuacgugucucuccggucgcugguugcaucaagcggcacucuggaauuuaauaacgagaguuucaauuggacagguguggcccagaacgggaccuccucugcuugcaaacgccgaagcgacaaguccuuuuucucacgucucaauugguuacaccagcugaaguauaaauacccagcacuuaacgucacgaugcccaauaacgagaaguuugauaaauuguauauauggggagugcaucacccuggcacugacaacgaucagaucagucuguacgcccaggcuagcggcagaguaaccguuucuacaaagaggucccaacagacugugauuccaaauaucgggucacggcccuggguccgcggagugagcaguagaauuucuaucuacuggaccauagugaaaccuggugacauucuacucaucaacuccacaggcaaucugauugccccaaggggguauuucaagauccggagcggaaagucgucuaucaugcgcuccgacgcgccgauuggcaaauguaacucagaaugcauaacccccaaugguaguaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacagcgagggaacuggccaggccgcagauuugaaguccacacaagcugccaucaaucagaucaacgguaaacucaaucgccugauugaaaagaccaacgagaaguuucaucagaucgaaaaagaguucucugaaguagaggggaggauucaggacuuagagaaguauguggaagauacgaaaauagaccuguggagcuacaacgcggagcuccuugucgcccuggaaaaucaacacaccaucgauuugacagacucagagaugaacaagcuauucgaaagaacuaaaaagcagcugcgggagaaugcagaggauaugggcaacggaugcuuuaagauuuaucauaaaugugacaaugcuugcaucggcaguauccgaaacgggaccuacgaucacgacguguaccgcgacgaagcccucaauaacagauuccagauuaagggaguugagcugaaauccgguuauaaggauuggauacuuuggaucagcuuugcuauuucuugcuuccuguuguguaucgugcuccugggcuuuauuaugugggccugccagaaagggaauaucagguguaacauaugcaucuga

SEQ ID NO: 122150 - RNA, 1701 nt, Artificial Sequence
  derived and/or modified sequence opt3 from hemagglutinin__InfluenzaA__AAY28295
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggaaaaucacugugucaaccaagcguagccaacagacaguaauuccaaacaucggaaguagacccaggguucgggacgugucuucccgcauaagcauuuacuggaccaucgucaagccuggugacauucugcuaaucaacucgacgggcaaucucaucgccccaagaggguauuucaaaauucagucuggaaaguccucaauaaugaggagugaugcgccgaucggcaaauguaacagcgagugcauuacucccaaugguuccaucccuaacgacaagccauuucagaaugugaaccggauaacauacggggcauguccccgcuaugugaaacaaaagacccugaaacuugccacuggaaugcgaaaugucccugaaaagcagacaagaggcauuuucggcgcuaucgccggguuuaucgagaacggaugggaagguaugguugauggcugguacggguucaggcaccagaauagcgagggaaccggccaagcagcugaccugaagucuacgcaggccgcgauuaaccagaucaaugguaaauugaaccggcucauugggaagaccaaugagaaauuucaccagauagaaaaggaguucucagaaguggagggccguauccaagaucuggaaaaauauguagaggacacaaagauugauuuauggaguuacaacgccgagcugcucguggcacuugaaaaucagcauacuaucgaccugaccgauuccgagaugaacaaguuguucgaacgcacaaagaagcagcuaagagagaacgcugaagacaugggaaauggcugcuuuaaaaucuaucacaagugugauaacgccugcauugggagcauaaggaauggaacuuacgaccaugacgucuaccgggaugaggcucugaacaaucgauuccagaucaaagguguggagcucaagucuggcuauaaggacuggauucuguggaucucauuugccauuaguugcuuccuucuguguguugcauugcucggguuuaucaugugggccugccaaaaaggaaacauacgcuguaauaucugcauuuga

SEQ ID NO: 122151 - RNA, 1701 nt, Artificial Sequence
  derived and/or modified sequence opt3 from hemagglutinin__InfluenzaA__AAY28305
augaaggccaucauugcucugagcuacauacucugccuuguguucgcacagaaacugcccggcaacgacaauuccaccgccacauuguguuuagggcaccaugcggucccuaacggaacucugguuaagacgaucaccaaugaucaaauugaggugacaaacgcuacugaauugguacagucuucaaguaccgguagaaucugcgacagcccacaccagauucucgauggcgagaauuguacacugaucgacgcccuucugggggauccgcauugcgacggauuucagaacaaagaaugggauuuguucguggagagguccaaggcauauucuaauuguuaccccuaugacgucccugauuacgugucgcuccggucacugguugccagcaguggcacccuggaauuuaacaaugaguccuucaacuggacugguguggcucaaaaugggacaucuagcgcaugcaaacgccgauccgacaagucauuuuucagucgucucaacugguuacaccagcugaaguauaaauacccagcccuuaaugucaccaugcccaacaaugagaaguuugauaaauuguauauauggggagugcaucacccuggcacggacagcgaucagaucucucuguacgcucaggccuccggcagaguaacuguuucaaccaagaggagccaacagacagugauuccaaacaucgggaguggacccuggguccggggugugucuucccgcauuagcaucuacuggacuauagugaaaccuggcgacauucuacucaucaacucgaccgggaaucugauugcgccaagaggauauuucaagaucaggucuggcaaguccucaaucaugcggagugacgcaccgauugguaaauguaacagcgaaugcauaacacccaauggguccaucccuaacgauaagccauuucagaaugucaaccgcauuaccuacggagccuguccccgauauguuaaacagaauacgcuuaagcuggcuacuggcaugagaaacgugccugagaaacaaacaaggggcaucuucggggccauagcaggauuuauugaaaaugguugggagggcaugauggacgggugguacggauuccggcaccagaacucugagggcaccggucaggcugccgaucuaaagagcacucaagcggccaucaaucagaucaacgggaaacucaaucgucugauugaaaagacaaacgagaaguuucaucagaucgaaaaagaguucucagaaguagagggccgcauucaggacuuagagaaguauguggaagauaccaaaauagaccuguggaguuacaaugcagagcuccuugucgcucuggaaaaccaacacacgaucgauuugaccgacuccgagaugaacaagcuauucgaaagaacuaaaaagcagcugagggagaaugccgaggauaugggaaacggcugcuuuaagauuuaucauaaaugugacaaugcuugcaucgggagcauccggaacggaacauacgaucacgacguguaccgagacgaagcccucaauaaccgcuuccagauuaaggguguugagcugaaaucuggcuauaaggauuggauacuuuggaucucauuugcaauuaguugcuuccuguuguguaucgugcuccugggguuuauuaugugggccugccagaaaggaaauaucagauguaacauaugcaucuga

SEQ ID NO: 122152 - RNA, 1701 nt, Artificial Sequence
  derived and/or modified sequence opt3 from hemagglutinin__InfluenzaA__AAY28325
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaauuguuagcaccaagaggagucaacagacagugaucccaaacauuggcucugggcccuggguccggggaguguccagccgcaucucgauauacuggacuauugugaaaccuggugacauccuacucauuaacucuaccggcaaucugaucgccccaagaggguauuucaagaucagguccggaaagucaaguauuaugcggagcgacgcgccgauaggcaaauguaacuccgaaugcaucacacccaaugguucuauuccuaacgauaagccauuucagaaugucaaccgcaucaccuacggggcauguccccgauauguuaaacagaauacgcuuaagcuggccacuggaaugagaaacgugccugagaaacaaacaaggggcauauucggcgcuauugccggguuuaucgaaaauggaugggaggguaugauggacggcugguacggguuccggcaccagaacagcgagggaaccggccaggcagcugauuugaagucaacucaagccgcgaucaaucagauuaacgguaaacucaaucgucugaucgaaaagacaaacgagaaguuucaucagauugaaaaagaguucgccgaaguagaggggcgcauacaggacuuagagaaguauguggaagauaccaaaaucgaccuguggaguuacaaugcagagcuccuugucgcucuggaaaaccaacacacgauugauuugaccgacuccgagaugaacaagcuauucgaaagaacuaaaaagcagcugagggagaaugccgaggauaugggcaacggaugcuuuaagaucuaucauaaaugugacaaugcuugcaucggcagcauucggaacgggacauacgaucacgacguguaccgagacgaagcccucaauaaccgcuuccagauaaagggaguugagcugaaaucugguuauaaggauuggauccuuuggauuucauuugcaaucaguugcuuccuguuguguauugugcuccugggcuuuaucaugugggccugccagaaagggaauauaagauguaacaucugcauuuga

SEQ ID NO: 122153 - RNA, 1701 nt, Artificial Sequence
  derived and/or modified sequence opt3 from hemagglutinin__InfluenzaA__AAY28335
augaagaccaucauugcccugagcuacauacucugccuuguguccgcucagaaacugcccggcaacgacaauucuacagcaacuuuguguuuagggcaccaugccgucccuaacggaacgcugguuaagaccaucacaaaugaucaaauugaggugacuaacgcgaccgaacuuguacagucaaguagcacauccagaaucugcgacucuccacaccagauucucgauggugagaauuguacccugaucgacgcucuacugggcgauccgcauugcgacggguuccagaacaaagaaugggauuuguuuguggagaggucgaaggccuauucaaauuguuaccccuaugacgucccugauuacgugagccuccggagucugguugcauccucuggaacucuggaauuuaacaaugagagcuucaacuggacaggcguggcccaaaaugguaccuccucagcuugcaaacgccgaagugacaagagcuucuuuucucgucucaacugguuacaccagcugaaguauaaauacccagcacuuaaugucacgaugcccaacaaugagaaguucgauaaauuguauauauggggagugcaucacccugggacugacuccgaucagaucucacuguacgcccaggcuagcggcagaguaaccguuaguacaaagaggucucaacagacugugauuccaaacaucggcucccggcccuggguccgcggggugagcucgagaauuucuaucuacuggaccauagugaaaccuggagacauucuacucaucaacuccacagguaaucugauugccccaaggggcuauuuuaagauccggucagggaagaguagcaucaugcgcuccgacgcgccgauuggaaaauguaacucugaaugcauaacccccaauggcagcaucccuaacgauaagccauuccagaaugucaaccgaauuacguacggugcaugucccagauauguuaaacagaauacucuuaagcuggccacagggaugaggaacgugccugagaaacaaacccggggaaucuuuggcgcuauagccggcuucauugaaaaugggugggagggaaugauggacgguugguacggcuuucgucaccagaacucagaggggacuggacaggcagcugauuugaagaguacacaagccgcgaucaaucagaucaacggcaaacucaaucgccugauugaaaagaccaacgagaaguuccaucagaucgaaaaagaguuuuccgaaguagaggguagaauacaggacuuagagaaguauguggaagauacgaaagucgaccuguggagcuacaaugccgagcuccuuguggcacuggaaaaccaacacaccauagauuugacagacucugagaugaacaagcuauucgaaaggacuaaaaagcagcugcgggagaaugcugaggauauggggaacggcugcuucaagaucuaucauaaaugugacaaugccugcauuggaucaauccgaaacggcaccuacgaucacgacguuuaccgcgacgaagcucucaauaacagauuucagaucaaggggguggagcugaaaaguggauauaaggauuggauucuuuggauuagcuucgccaucuccugcuuucuguuguguauuguccuccuggguuucaucaugugggcaugccagaaaggcaauauuagguguaacaucugcauauga

SEQ ID NO: 122154 - RNA, 1701 nt, Artificial Sequence; identical to SEQ ID NO: 122048
  derived and/or modified sequence opt3 from hemagglutinin__InfluenzaA__AAY28345

SEQ ID NO: 122155 - RNA, 1701 nt, Artificial Sequence; identical to SEQ ID NO: 122088
  derived and/or modified sequence opt3 from hemagglutinin__InfluenzaA__AAY28355

SEQ ID NO: 122156 - RNA, 1701 nt, Artificial Sequence
  derived and/or modified sequence opt3 from hemagglutinin__InfluenzaA__AAY28363
augaagaccaucauugcccugagcuacauacucugcaugguguucgcucagaaacuucccgucaacgacaauuccacagcaacucuguguuugggccaccaugccguuccuaacgggacguuagugaagaccaucacaaaugaucacauugagguaacuaacgcgaccgaacuggugcaaucuucaaguacaggaagaaucugcgacagcccacaucagauucuagauggugagaauuguacccucaucgacgcucugcuuggcgauccgcacugcgacggguuucagaacaaagaaugggaucuguucgucgagagguccacugccuauucuaauuguuaccccuaugacgugccugauuacgcaucguugcggucacucguugccagcaguggaacacuggaauuuaacaaugaguccuucaacuggaccggcguggcucagaaugguacgucuagcgcaugcaagcgccgauccauaaaaucauuuuucagucgucugaacuggcuccaucaauuaaaguauaaguacccaagccugaaugucacuaugcccaacaaugagaaauuugacaaacuuuauaucuggggagugcaccacccuucuaccgauuccgaccagauuucauuguacgcccaggcuagcgggagaguaacaguuaguacuaaaaggucucagcaaaccgugaucccaaacauuggcucccggcccuggguccgcggcgugagcucgagaaucucuauauacuggacaauugugaagccuggggauauccugcuaauuaacuccaccggaaaucucaucgccccaagggguuauuucaaaauccggucaggcaagaguagcauuaugcgcuccaacgcgccgauagggaaguguaauucugaaugcaucacgcccaacggaagcauuccuaaugacaaaccauuucagaacgucaaucgaaucacuuacggcgcaugucccagauauguuaagcagaacacacugaaacuugccaccgguaugaggaaugugccugagaagcagacucgggggauauucggagcuauugccggcuuuaucgaaaacggcugggaggggaugguagacggaugguacgguuuccgucaucaaaauucagagggcacagggcaggcagcugaucugaaaaguacccaggccgcgaucaaccaaauuaauggaaaguugaaccgccucaucgaaaagacgaaugagaaguuucaccagauugaaaaggaguucuccgaaguggagggcagaauacaggaccuggagaaauaugucgaagauaccaagaucgacuuauggagcuacaacgccgagcugcucguggcacuugaaaaccagcauacaauugaucugacugacucugagaugaauaaauuguucgaaaggacccggaagcaacuacgagagaacgcugaggauauggguaaugggugcuuuaaaaucuaucacaagugugacaacgccugcaucggcucaauucgcaauggaacauacgaucacgacguuuacagagaugaagcucugaacaauagguuccagauaaagggcguggagcucaaaaguggguauaaggacuggauccuguggauuagcuuugccaucuccugcuuccuucugugugucguguugcucggauuuauuaugugggcaugccagaaagguaacauccgguguaauauaugcaucuga

SEQ ID NO: 122157 - RNA, 1701 nt, Artificial Sequence; identical to SEQ ID NO: 122088
  derived and/or modified sequence opt3 from hemagglutinin__InfluenzaA__AAY28375

SEQ ID NO: 122158 - RNA, 1701 nt, Artificial Sequence; identical to SEQ ID NO: 122048
  derived and/or modified sequence opt3 from hemagglutinin__InfluenzaA__AAY28385

SEQ ID NO: 122159 - RNA, 1701 nt, Artificial Sequence
  derived and/or modified sequence opt3 from hemagglutinin__InfluenzaA__AAY28395
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuaacuuguacgcccaggcuucugggcguaucacuguguccaccaagagaucacaacagacaguaauuccaaacaucggaagcaggccccggguucgcgacgugaguucuagaauauccauuuacuggaccaucgucaagccuggugacauucugcuaaucaauagcacgggcaaccucaucgccccaaggggguauuucaagauucggucgggaaaaucuuccauaaugcgcucagaugcgccgaucggcaaguguaauagugagugcauuacucccaacgguagcaucccuaaugacaaaccauuucagaacgugaaucgaauaacauacggggcaugucccagauauauuaagcagaacacccugaaacuugccacuggaaugaggaaugugccugaaaagcaaacacggggcaucuucggcgcuaucgccggguuuauugagaacggaugggaagguauggucgauggcugguacggguuccgucaccaaaauuccgagggaaccggccaggcagcugaccugaaaucuacgcaggccgcgaucaaccagauuaaugguaaguugaaccgccucauagggaagaccaaugagaaauuucaccagaucgaaaaggaguucagcgaaguugagggcaggauucaggaucuggaaaaauauguggaggacacaaagaucgauuuauggucauacaacgccgagcugcucguagcacuugaaaaccaacauacuaucgaccugaccgauagugagaugaauaaauuguucgaaagaacaaagaagcagcuacgggagaacgcugaagacaugggaaauggcugcuuuaaaauuuaucacaagugugauaacgccugcauaggguccauccgaaauggaacuuacgaccaugacguguaccgcgaugaggcucugaacaauagauuccagauuaaaggugucgagcucaagagcggcuauaaagacuggauccuguggauuucuuuugccaucucaugcuuccuucuguguguggcauugcucggguuuauaaugugggccugccagaagggaaacaucagguguaauauuugcaucuga

SEQ ID NO: 122160 - RNA, 1701 nt, Artificial Sequence
  derived and/or modified sequence opt3 from hemagglutinin__InfluenzaA__AAY28405
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagaucucuucaacagguagaauuugcgacaauccacaccagauccucgauggcgagaacuguacccugauagacgcucuacugggggauccgcauugcgacggauuucagaauaaagaaugggauuuguucguggagaggaguaaggccuauagcaacuguuaccccuaugacgucccugauuacgugucccuccggucucugguugcaucgucaggcacucuggaauuuaauaacgagagcuucaauuggacagguguggcccaaaacgggaccaguuccgcuugcaaacgccgaucugacaagagcuuuuucucccgucucaauugguuacaccagcugaaguauaaauacccagcacuuaacgucacgaugcccaauaacgagaaguuugauaaauuguauaucuggggagugcaucacccuggcacugacucagaucagauuagucuguacgcccaggcuagcggcagaguaaccguuucuacaaagaggucccaacagacugugaucccaaacauugggucacggcccuggguccgcggagugagcaguagaaucucuauauacuggaccauugugaaaccuggugacauccuacucauuaauuccacaggcaaccugaucgccccaaggggguauuucaagauccggagcggaaagucgucuauuaugcgcuccgacgcgccgauaggcaaauguaauucagaaugcaucacccccaacgguaguauuccuaaugauaagccauuucagaacgucaaucgaaucacguacgggcccuguccuagauauguuaaacagaacacucuuaagcuggcaacaggaaugaggaaugugccagagaaacaaacccggggcauauucggcgccauugcuggguuuaucgaaaacggaugggaggguaugauggacggcugguacggguuccgucaccagaauagcgagggaacuggccaggccgcagauuugaaguccacacaagcugccaucaaccagauuaaugguaaacucaaccgccugaucgaaaagaccaaugagaaguuucaucagauugaaaaagaguucucugaaguagaggggagaauacaggacuuagagaaguauguggaagauacgaaaaucgaccuguggagcuacaacgcggagcuccuugucgcccuggaaaaccaacacaccauugauuugacagacucagagaugaauaagcuauucgaaaggacuaaaaagcagcugcgggagaacgcagaggauaugggcaauggaugcuuuaagaucuaucauaaaugugacaacgcuugcaucggcaguauucgaaaugggaccuacgaucacgacguguaccgcgacgaagcccucaacaauagauuccagauaaagggaguugagcugaaauccgguuauaaggauuggauccuuuggauuagcuuugcuaucucuugcuuccuguuguguauugugcuccugggcuuuaucaugugggccugccagaaagggaacauaagguguaauaucugcgucuga

SEQ ID NO: 122161 - RNA, 1701 nt, Artificial Sequence; identical to SEQ ID NO: 122048
  derived and/or modified sequence opt3 from hemagglutinin__InfluenzaA__AAY28486

SEQ ID NO: 122162 - RNA, 1701 nt, Artificial Sequence; identical to SEQ ID NO: 122048
  derived and/or modified sequence opt3 from hemagglutinin__InfluenzaA__AAY28521

SEQ ID NO: 122163 - RNA, 1701 nt, Artificial Sequence; identical to SEQ ID NO: 122047
  derived and/or modified sequence opt3 from hemagglutinin__InfluenzaA__AAY28531

SEQ ID NO: 122164 - RNA, 1701 nt, Artificial Sequence; identical to SEQ ID NO: 122048
  derived and/or modified sequence opt3 from hemagglutinin__InfluenzaA__AAY28541

SEQ ID NO: 122165 - RNA, 1701 nt, Artificial Sequence
  derived and/or modified sequence opt3 from hemagglutinin__InfluenzaA__AAY28551
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucuggccccuggguccgcgggguguccagccggaucucgauauacuggacaauugugaagccuggagauauccuacucauuaacucuaccgguaaucugaucgcgccaagaggcuauuucaaaaucagguccgggaagucaaguauuaugcggagcaacgcaccgauaggaaaguguaauuccgaaugcaucacgcccaacggcucuauuccuaaugacaaaccauuucagaacgucaaucgcaucacuuacggugccuguccccgauauguuaagcagaacacacuuaaacuggcuaccgggaugagaaaugugccugagaagcagacuaggggaauauucggcgccauugcaggcuuuaucgaaaacgggugggagggaaugguagacgguugguacggcuuccggcaucaaaauagcgaggggacaggacaggcugccgauuugaaaucaacccaggcggccaucaaccaaauuaauggcaagcucaaccgucugaucgagaaaacgaaugaaaaguuucaccagauugaaaaggaguucagugaaguggagggucgcauacaggacuuagagaaauaugucgaagauaccaagaucgaccugugguccuacaacgcagagcuccuuguggcucuggaaaaccagcauacaauugauuugacugacagcgagaugaauaaacuauucgaaagaaccaggaagcaacugcgggagaacgccgaggauauggggaauggcugcuuuaaaaucuaucacaagugugacaacgcuugcaucggaucuauucgaaauggcacauacgaucacgacguuuaccgcgaugaagcccucaacaauagauuccagauaaaggggguggagcugaaaucaggauauaaggacuggauccuuuggauuaguuuugcaaucagcugcuuccuguugugugucgugcuccuggguuuuauuaugugggccugccagaaaggcaacaucagguguaauauaugcaucuga

SEQ ID NO: 122166 - RNA, 1701 nt, Artificial Sequence; identical to SEQ ID NO: 122048
  derived and/or modified sequence opt3 from hemagglutinin__InfluenzaA__AAY28561

SEQ ID NO: 122167 - RNA, 1701 nt, Artificial Sequence; identical to SEQ ID NO: 122063
  derived and/or modified sequence opt3 from hemagglutinin__InfluenzaA__AAY28581

SEQ ID NO: 122168 - RNA, 1701 nt, Artificial Sequence
  derived and/or modified sequence opt3 from hemagglutinin__InfluenzaA__AAY28591
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuugacgucacuaugcccaauaacgagaaauuugauaaguuguauaucuggggagugcaccacccuagcaccgacucugaucagauuucccuguacgcucaggccucagggagaguaacaguuagcacuaaaaggagucagcaaaccgugaucccaaauauuggcucucggcccuggguccgcggcguguccagcagaaucucgauauacuggacaauugugaagccuggggacauccuacucauuaacucuaccggaaaccugaucgcgccaagggguuauuucaaaauccgguccggcaagucaaguauuaugcgcagcaaugcaccgauagggaaguguaacuccgaaugcaucacgcccaauggaucuauuccuaacgacaaaccauuucagaaugucaaccgaaucacuuacggcgccugucccagauauguuaagcagaauacacuuaaacuggcuaccgguaugaggaacgugccugagaagcagacucgggggauauucggagccauugcaggcuuuaucgaaaauggcugggaggggaugguagauggaugguacgguuuccgucaucaaaacagcgagggcacagggcaggcugccgacuugaaaucaacccaggcggccaucaaucaaauuaacggaaagcucaaucgccugaucgagaaaacgaacgaaaaguuucaccagauugaaaaggaguucagugaaguggagggcagaauacaggauuuagagaaauaugucgaagacaccaagaucgaucugugguccuacaaugcagagcuccuuguggcucuggaaaaccagcauacaauugacuugacugauagcgagaugaacaaacuauucgaaaggacccggaagcaacugcgagagaaugccgaggacauggguaacgggugcuuuaaaaucuaucacaagugugauaaugcuugcaucggcucuauucgcaacggaacauacgaccacgauguuuacagagacgaagcccucaauaacagguuccagauaaagggcguggagcugaaaucaggguauaaggacuggauccuuuggauuaguuuugcaaucagcugcuuccuguugugugucgugcuccugggauuuauuaugugggccugccagaaagguaauauccgguguaacauaugcaucuga

SEQ ID NO: 122169 - RNA, 1701 nt, Artificial Sequence; identical to SEQ ID NO: 122088
  derived and/or modified sequence opt3 from hemagglutinin__InfluenzaA__AAY28608

SEQ ID NO: 122170 - RNA, 1701 nt, Artificial Sequence
  derived and/or modified sequence opt3 from hemagglutinin__InfluenzaA__AAY28618
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaaugagcauauacuggaccauugucaagccuggugacauccugcuaauuaauucgacgggcaaccucaucgccccaaggggguauuucaagauccggucuggaaaauccucaauuaugcgcagugacgcgccgauaggcaaguguaauagcgagugcaucacucccaacgguuccauuccuaaugauaaaccauuucagaacgugaaucgaaucacauacggggcaugucccagauaugugaagcagaacacccugaaacuugccacuggaaugaggaaugucccugaaaagcaaacacggggcauauucggcgcuauugccggguuuaucgagaacggaugggaagguaugguugacggcugguacggguuccgucaccaaaauucugagggaaccggccaggcagcugaucugaaaagcacgcaggccgcgaucaaccagauuaaugguaaguugaaccgccucaucgggaagaccaaugagaaauuucaccagauugaaaaggaguucucagaaguggagggcagaauacaggaccuggaaaaauauguagaggauacaaagaucgacuuauggaguuacaacgccgagcugcucguggcacuugaaaaccaacauacuauugaucugaccgacuccgagaugaauaaauuguucgaaaggacaaagaagcagcuacgggagaacgcugaagauaugggaaauggcugcuuuaaaaucuaucacaagugugacaacgccugcaucgagagcauucgaaaugggacuuacgaucaugacgucuaccgcgacgaggcucugaacaauagauuccagauaaaaggaguggaacucaagucugguuauaaagauuggauccuguggauuucauuugccaucaguugcuuccuucuguguguugcauugcucggcuuuauuaugugggccugccagaaggggaacaucagguguaauauaugcaucuga

SEQ ID NO: 122171 - RNA, 1701 nt, Artificial Sequence; identical to SEQ ID NO: 122063
  derived and/or modified sequence opt3 from hemagglutinin__InfluenzaA__AAY28638

SEQ ID NO: 122172 - RNA, 1701 nt, Artificial Sequence
  derived and/or modified sequence opt3 from hemagglutinin__InfluenzaA__AAY28648
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggaguggacccuggguccggggugugucuucccgcauuagcaucuacuggaccauagugaaaccuggcgacauucuacucaucaacucgacagggaaucugauugccccaagaggauauuucaagaucaggucuggcaaguccucaaucaugcggagugacgcgccgauugguaaauguaacagcgaaugcauaacccccaauggguccaucccuaacgauaagccauuucagaaugucaaccgcauuacguacggagcauguccccgauauguuaaacagaauacucuuaagcuggccacaggcaugagaaacgugccugagaaacaaaccaggggcaucuucggggcuauagccggauuuauugaaaaugguugggagggcaugauggacgggugguacggauuccggcaccagaacucugagggcacuggucaggcagcugaucuaaagagcacacaagccgcgaucaaucagaucaacgggaaacucaaucgucugauugaaaagaccaacgagaaguuucaucagaucgaaaaagaguucucagaaguagagggccgcauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugagggagaaugcugaggauaugggaaacggcugcuuuaagauuuaucauaaaugugacaaugccugcaucgggagcauccggaacggaaccuacgaucacgacguguaccgagacgaagcucucaauaaccgcuuccagauuaaggguguugagcugaaaucuggcuauaaggauuggauacuuuggaucucauuugccauuaguugcuuccuguuguguaucgugcuccugggguuuauuaugugggcaugccagaaaggaaauaucagauguaacauaugcaucuga

SEQ ID NO: 122173 - RNA, 1701 nt, Artificial Sequence
  derived and/or modified sequence opt3 from hemagglutinin__InfluenzaA__AAY44610
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagaaauaaagccuauuccaacuguuaccccuaugacgucccugauuacgcaucuuugaggucgcucguggccucaagcgguacucuggaguuuaauaacgaaaguuucgacuggacagggguuacccagaauggaacguccucugcuugcaagcggcgcagcaacaaguccuuuuucucacgacugaauuggcucacucauuuaaaauauaaguacccagcacugaacgugaccaugcccaauaacgagaaauuugauaaacuuuauaucuggggcguccaccauccuggcacagacagugaucagauuagcuuguacgcccaggcuucugggcguaucacuguguccaccaagagaucacaacagacaguaauuccaaacaucggaagcaggccccggguucgcgacgugaguucuagaauauccauuuacuggaccaucgucaagccuggugacauucugcuaaucaauagcacgggcaaccucaucgccccaaggggguauuucaagauucggucgggaaaaucuuccauaaugcgcucagaugcgccgaucggcaaguguaauagugagugcauuacucccaacgguagcaucccuaaugacaaaccauuucagaacgugaaucgaauaacauacggggcaugucccagauaugugaagcagaacacccugaaacuugccacuggaaugaggaaugucccugaaaagcaaacacggggcauuuucggcgcuaucgccggguuuaucgagaacggaugggaagguaugguugauggcugguacggguuccgucaccaaaauuccgagggaaccggccaggcagcugaccugaaaucuacgcaggccgcgauuaaccagaucaaugguaaguugaaccgccucauugggaagaccaaugagaaauuucaccagauagaaaaggaguucagcgaaguggagggcagaauccaggaucuggaaaaauauguagaggacacaaagauugauuuauggucauacaacgccgagcugcucguggcacuugaaaaccaacauacuaucgaccugaccgauagugagaugaauaaauuguucgaaaggacaaagaagcagcuacgggagaacgcugaagacaugggaaauggcugcuuuaaaaucuaucacaagugugauaacgccugcauuggguccauacgaaauggaacuuacgaccaugacgucuaccgcgaugaggcucugaacaauagauuccagaucaaagguguggagcucaagagcggcuauaaagacuggauucuguggaucucuuuugccauuucaugcuuccuucuguguguugcauugcucggguuuaucaugugggccugccagaagggaaacauaagguguaauaucugcauuuga

SEQ ID NO: 122174 - RNA, 1701 nt, Artificial Sequence
  derived and/or modified sequence opt3 from hemagglutinin__InfluenzaA__AAY44620
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgaaaaacucaaucgccugauugagaagaccaacgaaaaguuucaucagaucgagaaagaguucucagaaguagaggguaggauucaggacuuagaaaaguauguggaggauacgaaaauagaccuguggaguuacaaugcggaacuccuugucgcccuggagaaccaacacaccaucgauuugacagacuccgaaaugaacaagcuauucgagagaacuaaaaagcagcugcgggagaaugcagaagauauggggaacggcugcuuuaagauuuaucauaaaugugacaaugcuugcaucggaagcauccgaaacggcaccuacgaucacgacguguaccgcgacgaggcccucaauaacagauuccagauuaaggggguugaacugaaaucuggauauaaggauuggauacuuuggaucucauuugcuauuaguugcuuccuguuguguaucgugcuccuggguuuuauuaugugggccugccagaaaggcaauaucagguguaacauaugcaucuga

SEQ ID NO: 122175 - RNA, 1701 nt, Artificial Sequence; identical to SEQ ID NO: 122096
  derived and/or modified sequence opt3 from hemagglutinin__InfluenzaA__AAY44621

SEQ ID NO: 122176 - RNA, 1701 nt, Artificial Sequence; identical to SEQ ID NO: 122063
  derived and/or modified sequence opt3 from hemagglutinin__InfluenzaA__AAY44631

SEQ ID NO: 122177 - RNA, 1701 nt, Artificial Sequence
  derived and/or modified sequence opt3 from hemagglutinin__InfluenzaA__AAY44641
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugcggagcuccuugucgcccuggaaaaccaacacaccaucgauuugacagacuccgagaugaacaagcuauucgaaagaacuaaaaagcagcugcgggagaaugcagaggauaugggcaacggaugcuuuaagauuuaucauaaaugugacaaugcuugcaucggcagcauccgaaacgggaccuacgaucacgacguguaccgcgacgaagcccucaauaacagauuccagauuaagggaguugagcugaaaucugguuauaaggauuggauacuuuggaucucauuugcuauuaguugcuuccuguuguguaucggccuccugggguuuauuaugugggccugccagaaaggaaauaucagguguaacauaugcaucuga

SEQ ID NO: 122178 - RNA, 1701 nt, Artificial Sequence
  derived and/or modified sequence opt3 from hemagglutinin__InfluenzaA__AAY44651
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccugggaacgcggcgucuccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgagugcaucacgcccaacggaucuauuccuaaugacaaaccauuucagaacgugaaucgaaucacuuacggcgccugucccagauaugucaagcagaacacacuuaaacuggcuaccgguaugaggaauguuccugaaaagcagacucgggggauauucggagccauugcaggcuuuaucgagaacggcugggaggggaugguggacggaugguacgguuuccgucaucaaaauagcgaaggcacagggcaggcugccgauuugaaaucaacccaggcggccaucaaccaaauuaauggaaagcucaaccgccugaucgagaaaacgaaugaaaaguuucaccagauugagaaggaguucagugaaguagagggcagaauacaggacuuagaaaaauauguggaggauaccaagaucgaccugugguccuacaacgcagaacuccuugucgcucuggagaaccagcauacaauugauuugacugacagcgaaaugaauaaacuauucgagaggacccggaagcaacugaaagagaacgccgaagauauggguaaugggugcuuuaagaucuaucacaagugugacaacgcuugcaucggcucuauucgaaauggaacauacgaucacgacguguaccgcgaugaggcccucaacaauagauuccagauaaaaggcguugaacugaagucaggguauaaagacuggauccuuuggauuaguuuugcaaucagcugcuuccuguugugugugguccuccugggauuuauuaugugggccugccagaaggguaacaucagguguaauauaugcaucuga

SEQ ID NO: 122179 - RNA, 1701 nt, Artificial Sequence
  derived and/or modified sequence opt3 from hemagglutinin__InfluenzaA__AAY44755
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggggccaacagacuguuauuccaaacaucgggagucggcccugggugcgcggagucucuuccauuaucagcauauacuggaccauugugaaaccuggugauauccuacucauuaauucgacaggcaaccugaucgcgccaagaggguauuucaagaucaggucuggaaaguccucagugaugcggagugacgcaagcauuggcaaauguaauuccgaaugcauaaccccgaacgguucuauccccaaugacaagccuuuucagaacgucaaucgcauuacguacggggccuguccacgauauguuaaacagaacacucuuaagcuggcuacaggaaugagaaaugugcccgagaaacaaaccaggggcaucuucggcgccauagcaggguuuauugaaaacggaugggaggguaugguagauggcugguacggguuccggcaccagaauagcgagggaacuggccaggcugccgacuugaagucaacacaagcggccaucaaccagaucaaugguaaacucaaccgucugauugaaaagaccaaugagaaguuucaucagaucgaaaaagaguucagugaaguggaggggcgcauucaggauuuagagaaguaugucgaagacacgaaaauagaucugugguccuacaacgcagagcuccuuguggcucuggaaaaccaacacaccaucgacuugacagauagcgagaugaauaagcuauucgaaagaacuaaaaagcagcugagggagaacgccgaggacaugggcaauggaugcuuuaagauuuaucauaaaugugauaacgcuugcaucggcucuauccggaaugggaccuacgaccacgauguuuaccgagacgaagcccucaacaaucgcuuccagauuaagggaguggagcugaaaucagguuauaaggacuggauacuuuggaucaguuuugcaauuagcugcuuccuguugugugucgugcuccugggcuuuaucaugugggccugccagaaagggaacauuagauguaauaucugcauauga

SEQ ID NO: 122180 - RNA, 1701 nt, Artificial Sequence
  derived and/or modified sequence opt3 from hemagglutinin__InfluenzaA__AAY44775
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucaggauaaagaaugggacuuguucgucgagagguccacugccuauucuaacuguuaccccuaugaugugccugacuacgcaucgcuccggucacugguugccagcaguggaacacuggaauuuaauaacgaguccuucaauuggaccggcguggcucagaacgguacgucuagcgcaugcaagcgccgauccauaaaaucauuuuucagucgucucaauugguuacaucaacugaaguauaaguacccagcccuuaacgucacuaugcccaauaacgagaaauuugauaaguuguauaucuggggagugcaccacccuagcaccgacucugaucagauuucccuguacgcucaggccucagggagaguaacaguuagcacuaaaaggagucagcaaaccgugaucccaaauauuggcucucggcccuggguccgcggcguguccagcagaaucucgauauacuggacaauugugaagccuggggacauccuacucauuaacucuaccggaaaccugaucgcgccaagggguuauuucaaaauccgguccggcaagucaaguauuaugcgcagcaaugcaccgauagggaaguguaacuccgaaugcaucacgcccaauggaucuauuccuaacgacaaaccauuucagaaugucaaccgaaucacuuacggcgccugucccagauauguuaagcagacaacccuuaaacuggcuacugguaugaggaaugugccugagaagcagacacgggggauauucggagccauugcaggcuuuaucgaaaacggcugggaggggaugguagauggaugguacgguuuccgucaucaaaauagcgagggcaccgggcaggcugccgacuugaaaucaacgcaggcggccaucaaccaaauuaauggaaagcucaaccgccugaucgagaaaaccaaugaaaaguuucaccagauugaaaaggaguucagugaaguggagggcagaauacaggauuuagagaaauaugucgaagacacaaagaucgaucugugguccuacaacgcagagcuccuuguggcucuggaaaaucagcauacuauugacuugaccgauagcgagaugaacaaacuauucgaaaggacacggaagcaacugcgagagaacgccgaggacauggguaaugggugcuuuaaaaucuaucacaagugugauaacgcuugcaucggcucuauucgcaauggaacuuacgaccacgauguuuacagagacgaagcccucaacaauagguuccagauaaagggcguggagcugaaaucaggguauaaggacuggauccuuuggauuaguuuugcaaucagcugcuuccuguugugugucgugcuccugggauuuauuaugugggccugccagaaagguaacauccgguguaauauaugcaucuga

SEQ ID NO: 122181 - RNA, 1701 nt, Artificial Sequence; identical to SEQ ID NO: 122088
  derived and/or modified sequence opt3 from hemagglutinin__InfluenzaA__AAY44785
